(12) United States Patent
Case et al.

(10) Patent No.: US 9,708,375 B2
(45) Date of Patent: Jul. 18, 2017

(54) INHIBITORY POLYPEPTIDES SPECIFIC TO WNT INHIBITORS

(71) Applicant: AMGEN INC., Thousand Oaks, CA (US)

(72) Inventors: Ryan B. Case, Alameda, CA (US); Benjamin M. Alba, South San Francisco, CA (US); Alice Bakker, Cupertino, CA (US); Irwin Chen, Santa Monico, CA (US); Amy N. Duguay, San Mateo, CA (US); Monica Florio, Thousand Oaks, CA (US); Peng Li, San Francisco, CA (US); Mark Leo Michaels, Encino, CA (US); Mei-Mei Tsai, Thousand Oaks, CA (US)

(73) Assignee: Amgen Inc., Thousand Oaks, CA (US)

( * ) Notice: Subject to any disclaimer, the term of this patent is extended or adjusted under 35 U.S.C. 154(b) by 50 days.

(21) Appl. No.: 14/776,917

(22) PCT Filed: Mar. 14, 2014

(86) PCT No.: PCT/US2014/029388
§ 371 (c)(1),
(2) Date: Sep. 15, 2015

(87) PCT Pub. No.: WO2014/144817
PCT Pub. Date: Sep. 18, 2014

(65) Prior Publication Data
US 2016/0024158 A1   Jan. 28, 2016

Related U.S. Application Data

(60) Provisional application No. 61/793,143, filed on Mar. 15, 2013.

(51) Int. Cl.
| | | |
|---|---|---|
| *C07K 14/435* | (2006.01) | |
| *C07K 16/18* | (2006.01) | |
| *C07K 14/51* | (2006.01) | |
| *A61K 47/48* | (2006.01) | |

(52) U.S. Cl.
CPC ...... *C07K 14/435* (2013.01); *A61K 47/48215* (2013.01); *C07K 14/51* (2013.01); *C07K 16/18* (2013.01); *C07K 2319/31* (2013.01)

(58) Field of Classification Search
CPC .. C07K 14/435; C07K 16/18; C07K 2319/31; C07K 2319/74
See application file for complete search history.

(56) References Cited

U.S. PATENT DOCUMENTS

| | | | | |
|---|---|---|---|---|
| 7,879,322 B2 * | 2/2011 | Kneissel | ............... | A61K 31/663 424/130.1 |
| 8,246,953 B2 * | 8/2012 | Kneissel | ............... | A61K 31/663 424/130.1 |
| 9,133,272 B2 * | 9/2015 | Florio | ............... | C07K 16/18 |
| 2009/0130113 A1 * | 5/2009 | Kneissel | ............... | A61K 31/663 424/139.1 |
| 2010/0028335 A1 * | 2/2010 | Lu | ............... | G01N 33/6893 424/130.1 |
| 2013/0164293 A1 * | 6/2013 | Florio | ............... | C07K 16/18 424/136.1 |

* cited by examiner

*Primary Examiner* — Daniel C Gamett

(57) ABSTRACT

The present application is directed to avimers and peptides and various combinations thereof in addition to methods of making and using them.

10 Claims, 42 Drawing Sheets

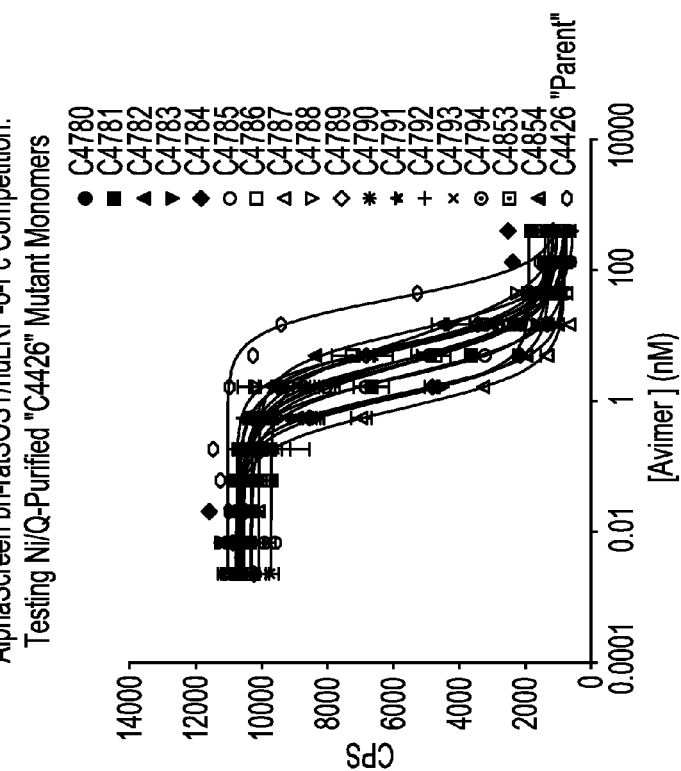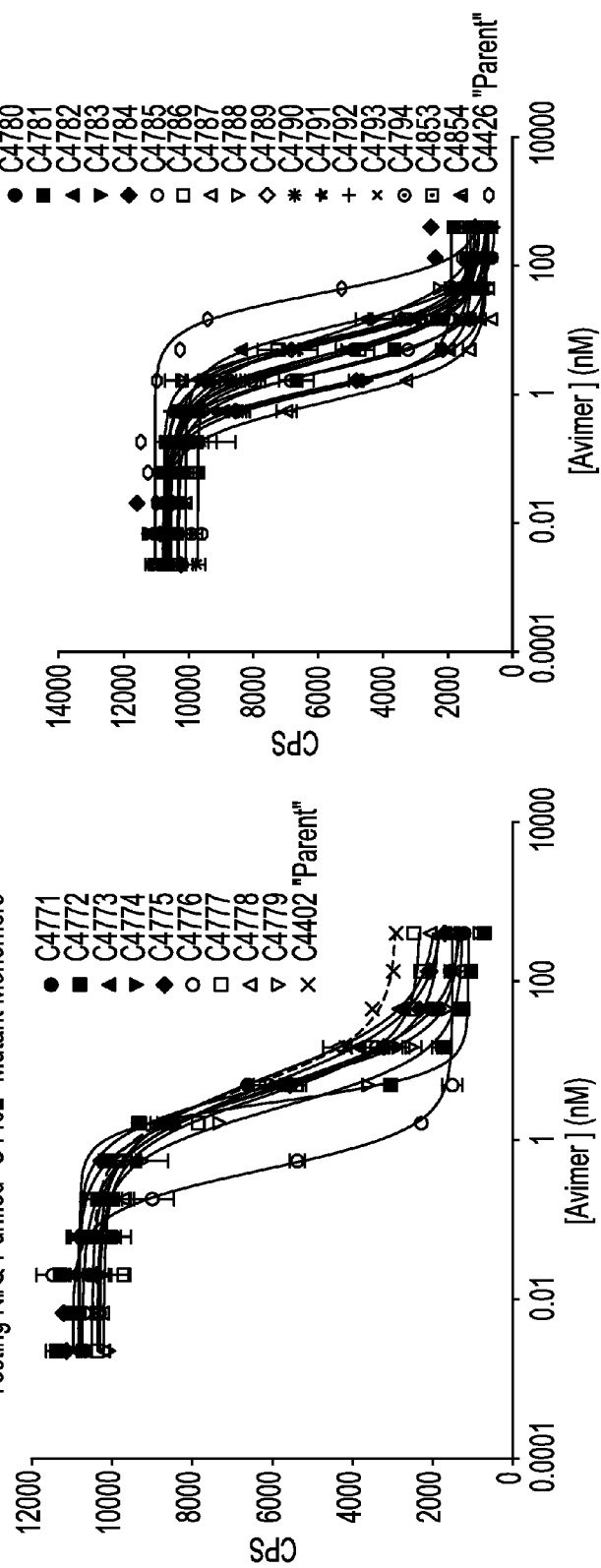

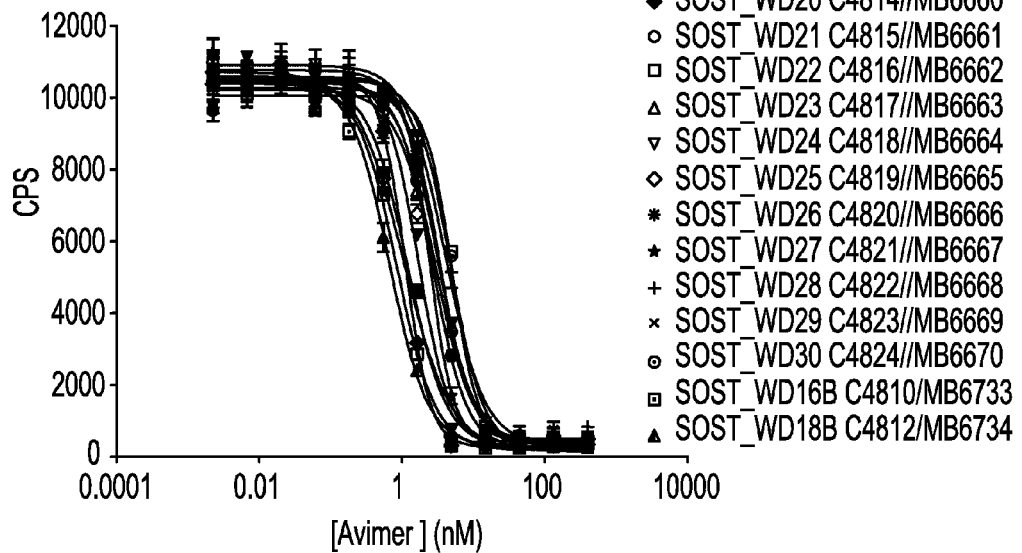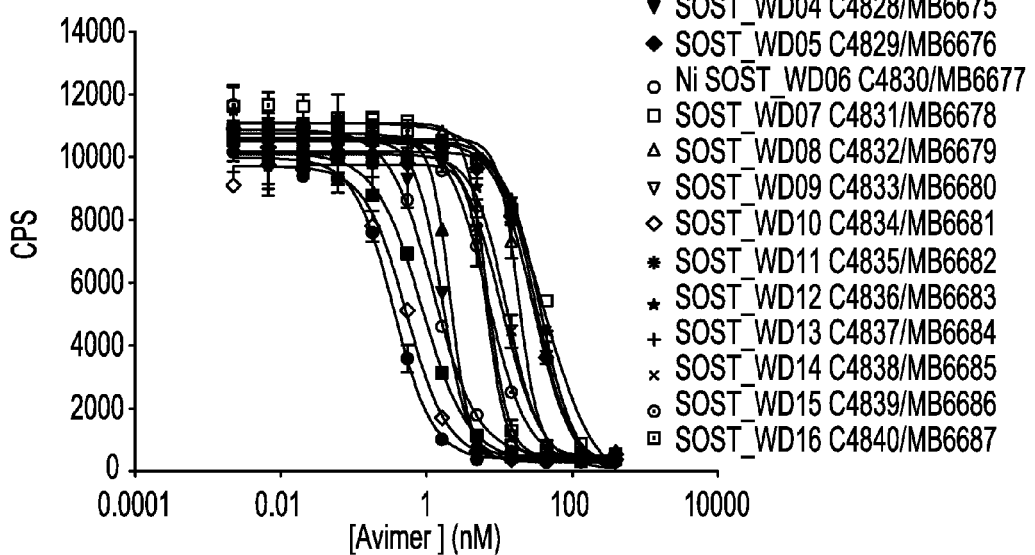

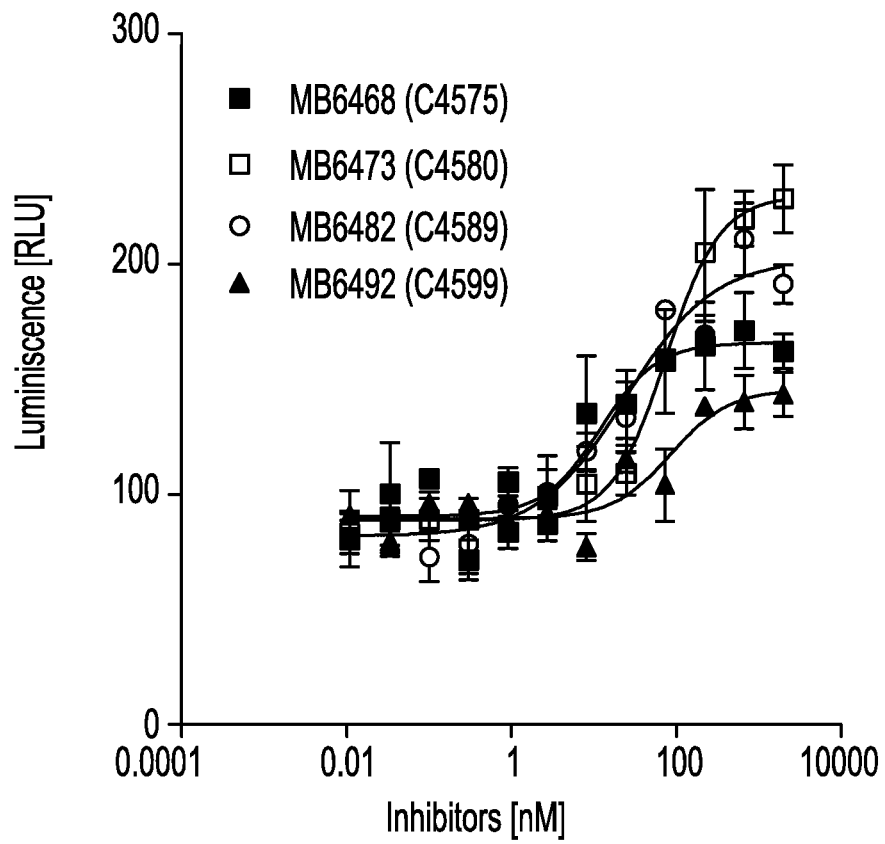

AlphaScreen bn-ratSclerostin/huLRP-6/Fc Competition:
Testing Engineered Dimers

AlphaScreen bn-ratSclerostin/huLRP-6/Fc Competition:
Testing Engineered Dimers

● C4804-M44_mM09 C4900/MB6823
■ M73_mM08-M44_mM06 C4901/MB6824
▲ M73_mM08-M44_mM09 C4902/MB6825
▼ C4605-M44-M22_mM05-(G4S)2 C4903/MB6826
◆ C4605-M44-M22_mM05-HK-SA C4904/MB6827
○ M44-M44 C4575/MB6828
□ M40_mM09-M44 C4578/MB6829
△ M41_mM03-M44 C4579/MB6830
▽ M40_mM09-M73 C4584/MB6831
◇ M03_mM18-M03_mM18 C4589/MB6832
✻ M44-M40_mM09 C4593/MB6833
⬟ M44-M22_mM05 C4605/MB6834

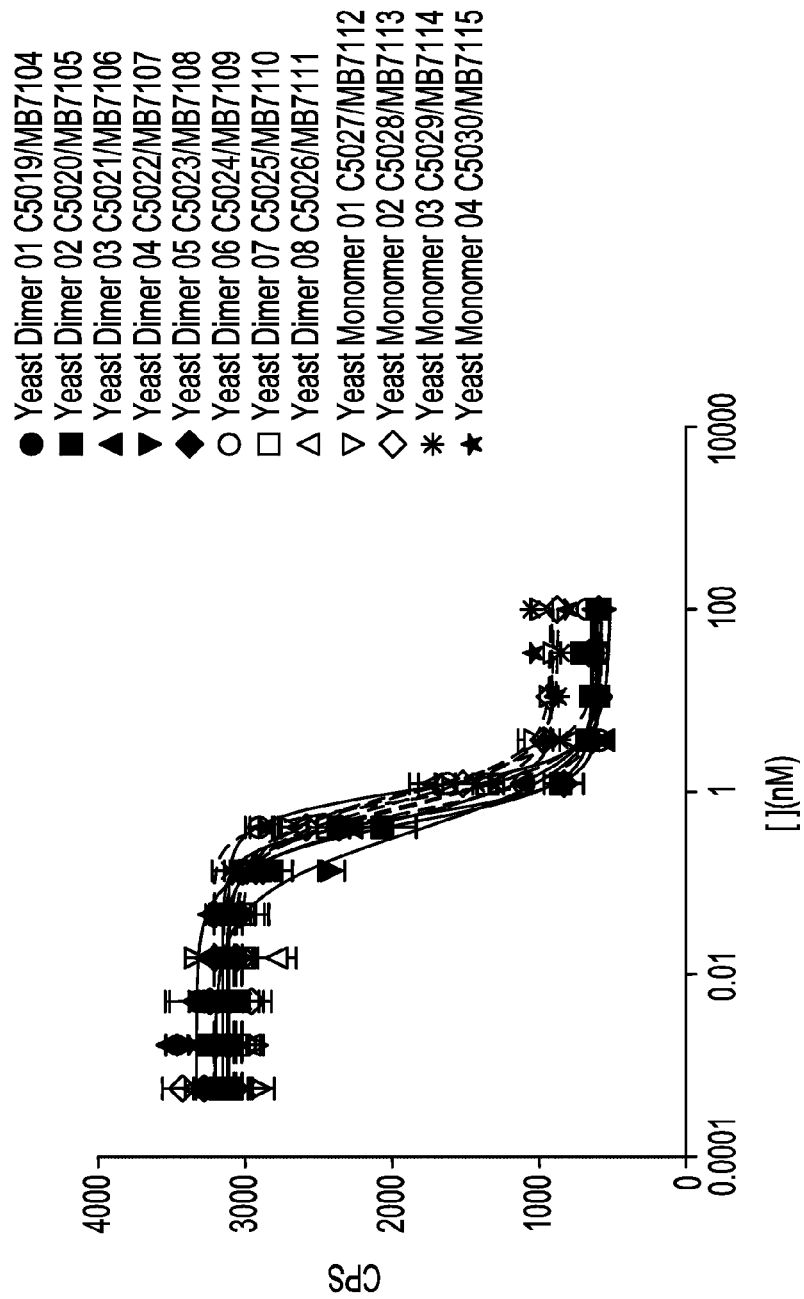

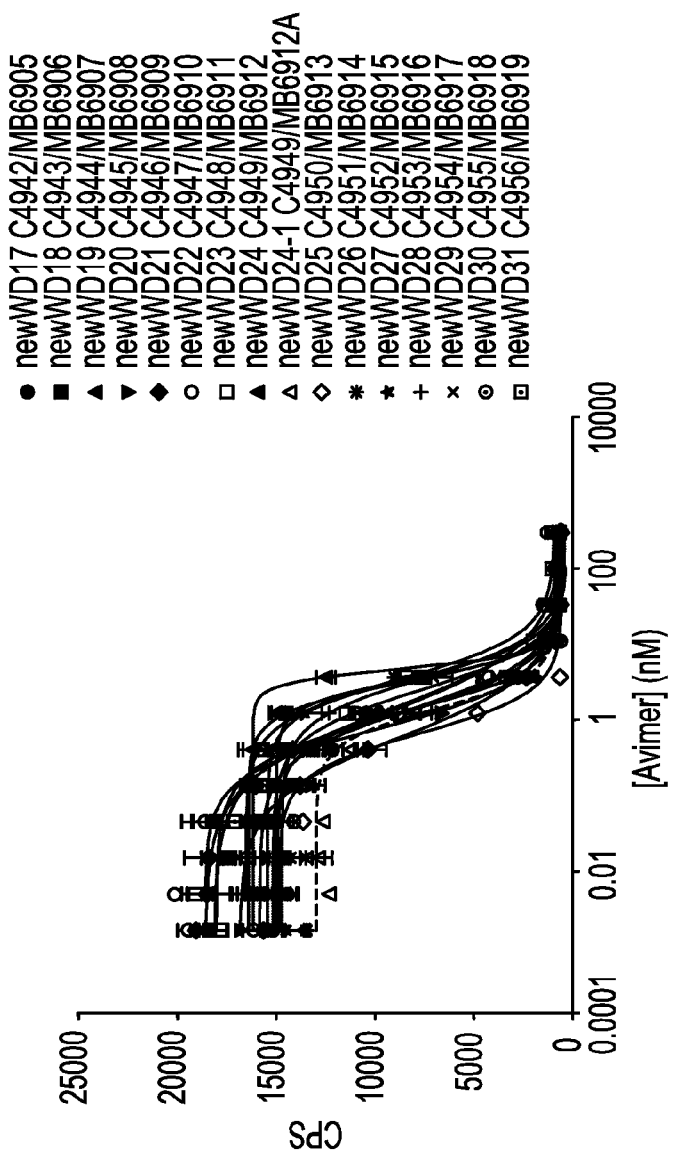

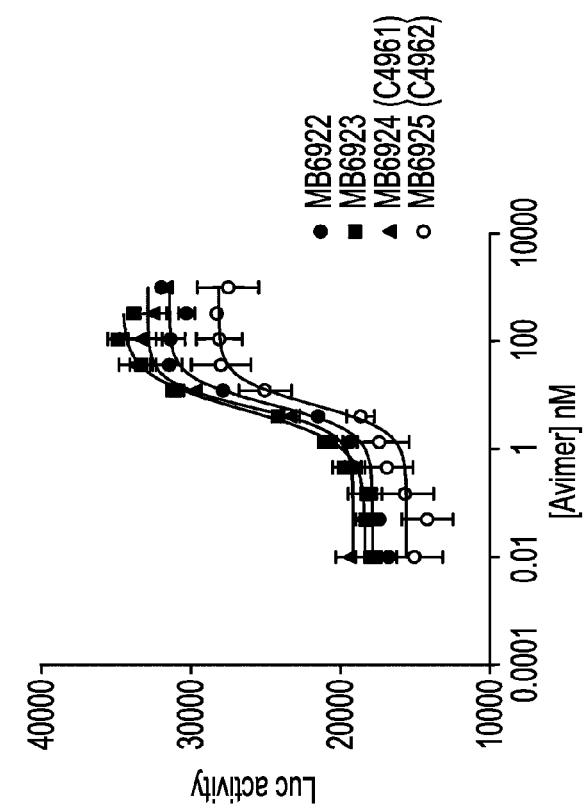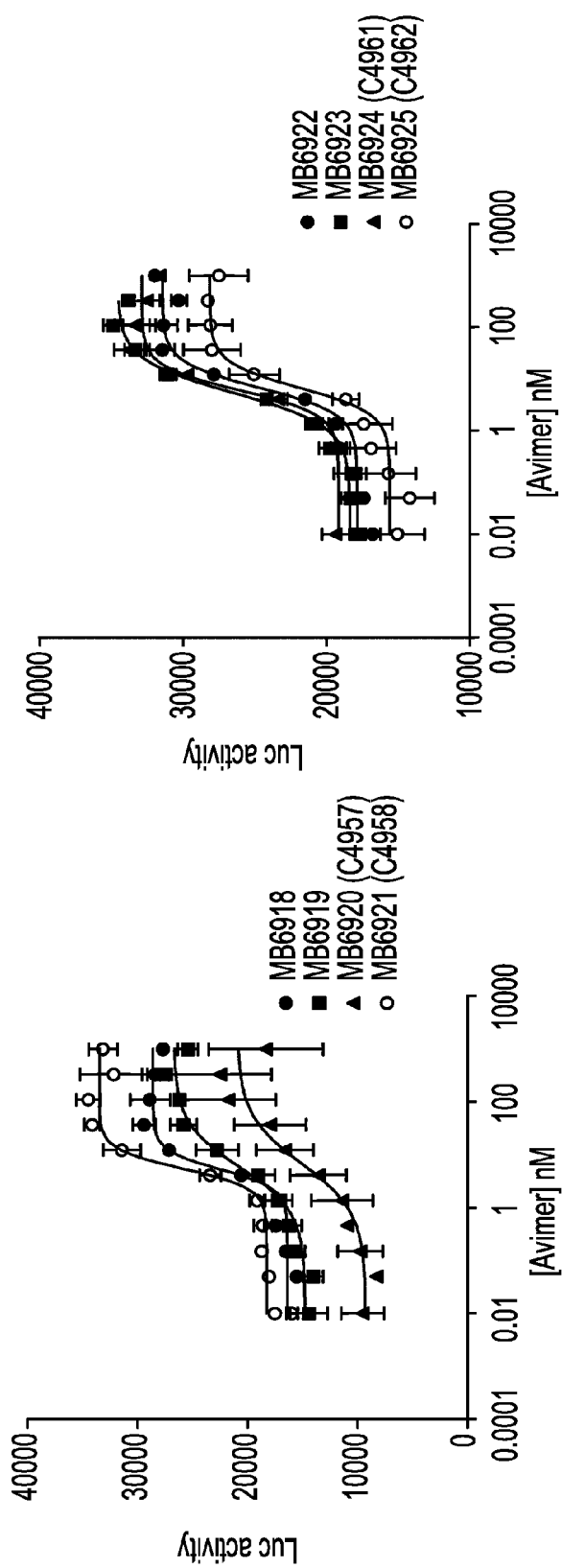

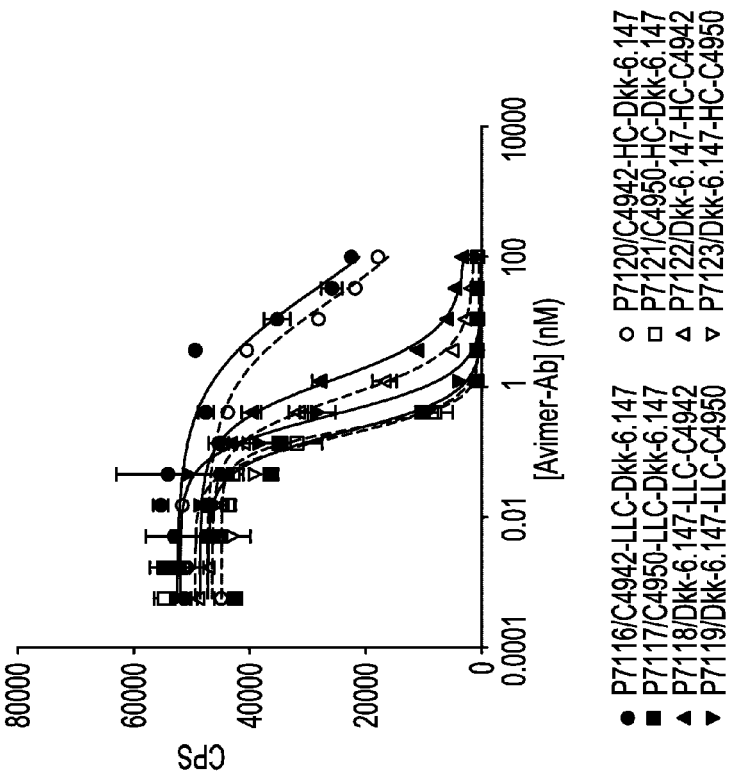
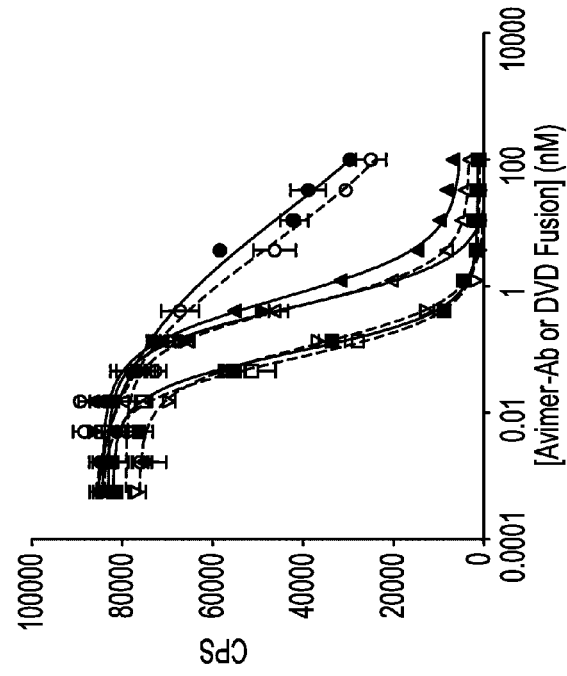
FIG. 10A
FIG. 10B

AlphaScreen Inhibition:
ratSclerostin/muLRP-6

AlphaScreen Inhibition:
huSclerostin/muLRP-6

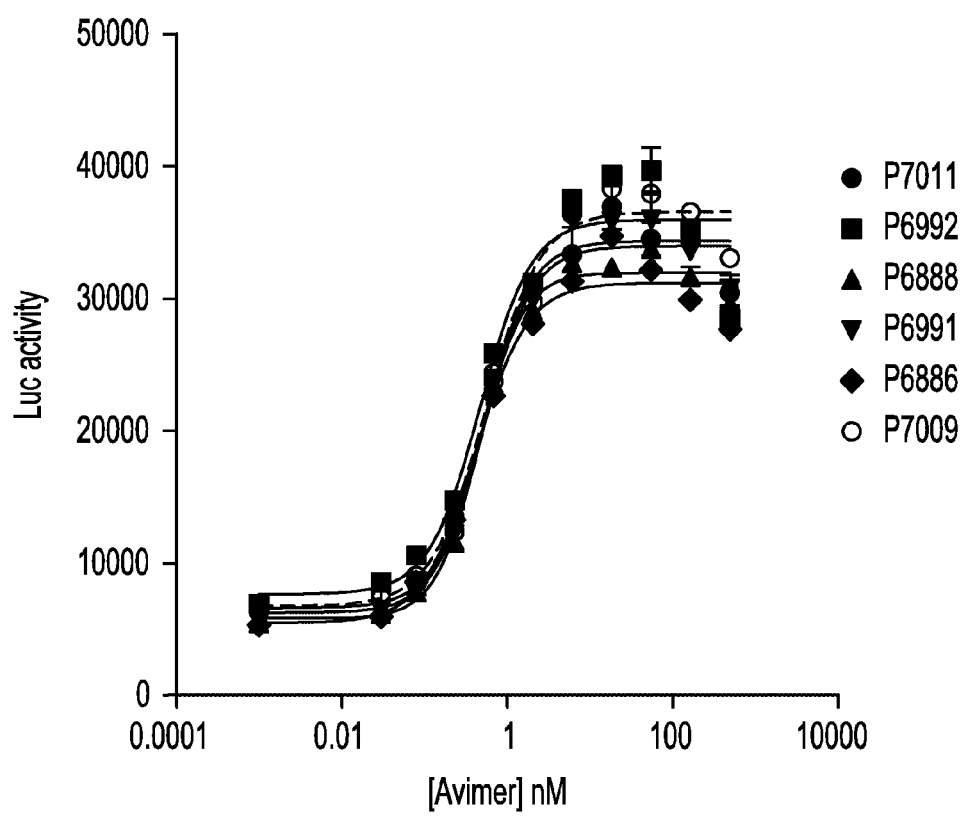

Plasma concentration of 8 Ab-Avimers of Anti-SOST/DKK1 following 5 mg/kg SC administration in SD Rats Plasma concentration of 8 Ab-Avimers of Anti-SOST/DKK1 following 5 mg/kg SC administration in SD Rats BMC % (week 2)

BMD % (week 2)

BMC % (week 2)

BMD %
a (except FM2-3)

- Vehicle
- huFM2 DVD 1g
- FM2 Avimer-1
- FM2 Avimer-2
- FM2 Avimer-3
- FM2 Avimer-4

BMC %

- Vehicle
- huFM2 DVD 1g
- FM2 Avimer-1
- FM2 Avimer-2
- FM2 Avimer-3
- FM2 Avimer-4

AlphaScreen bn-ratSclerostin/huLRP-6 Competition:
Testing Point Mutations and Linker Changes of C4578

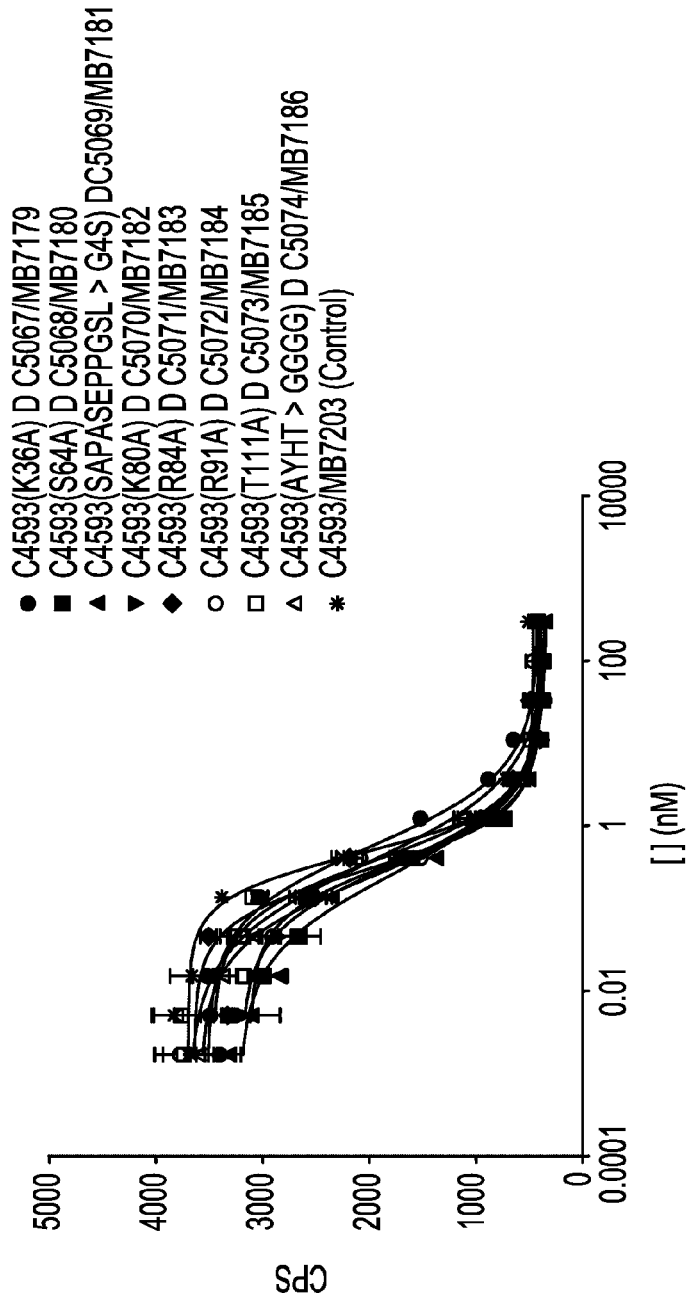

AlphaScreen Inhibition:
huSclerostin/LRP-6/Fc
C4894 Linker Optimzations

AlphaScreen Binding:
huSclerostin/LRP-6/Fc
C4893 Linker Optimizations

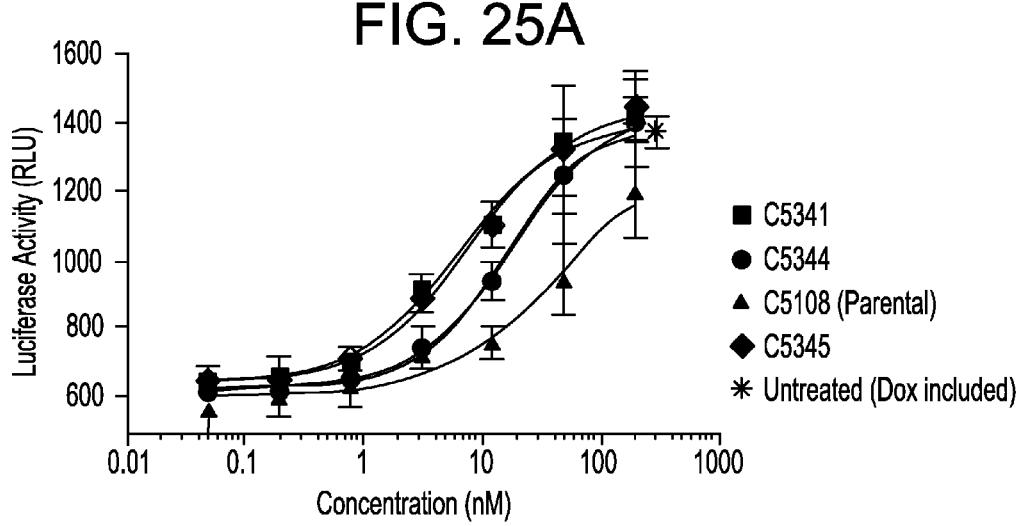
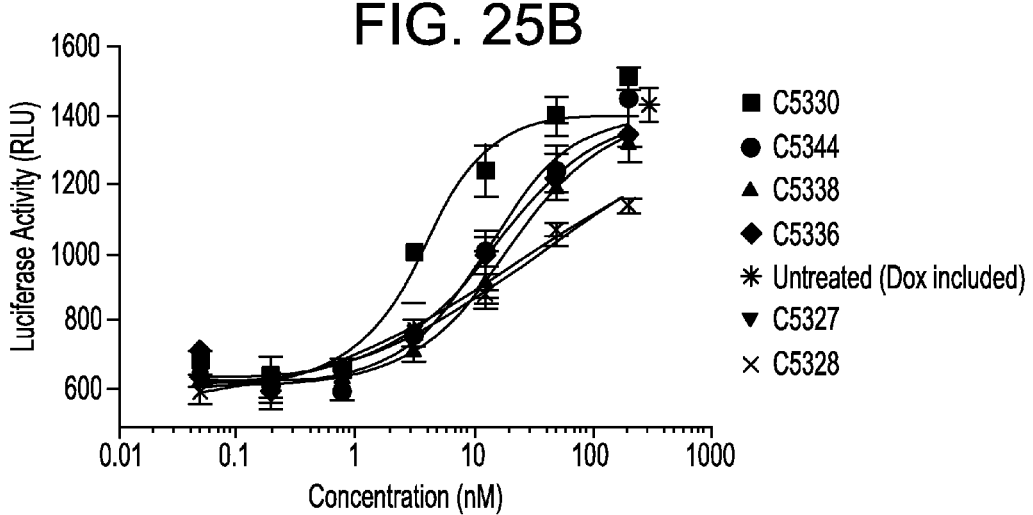

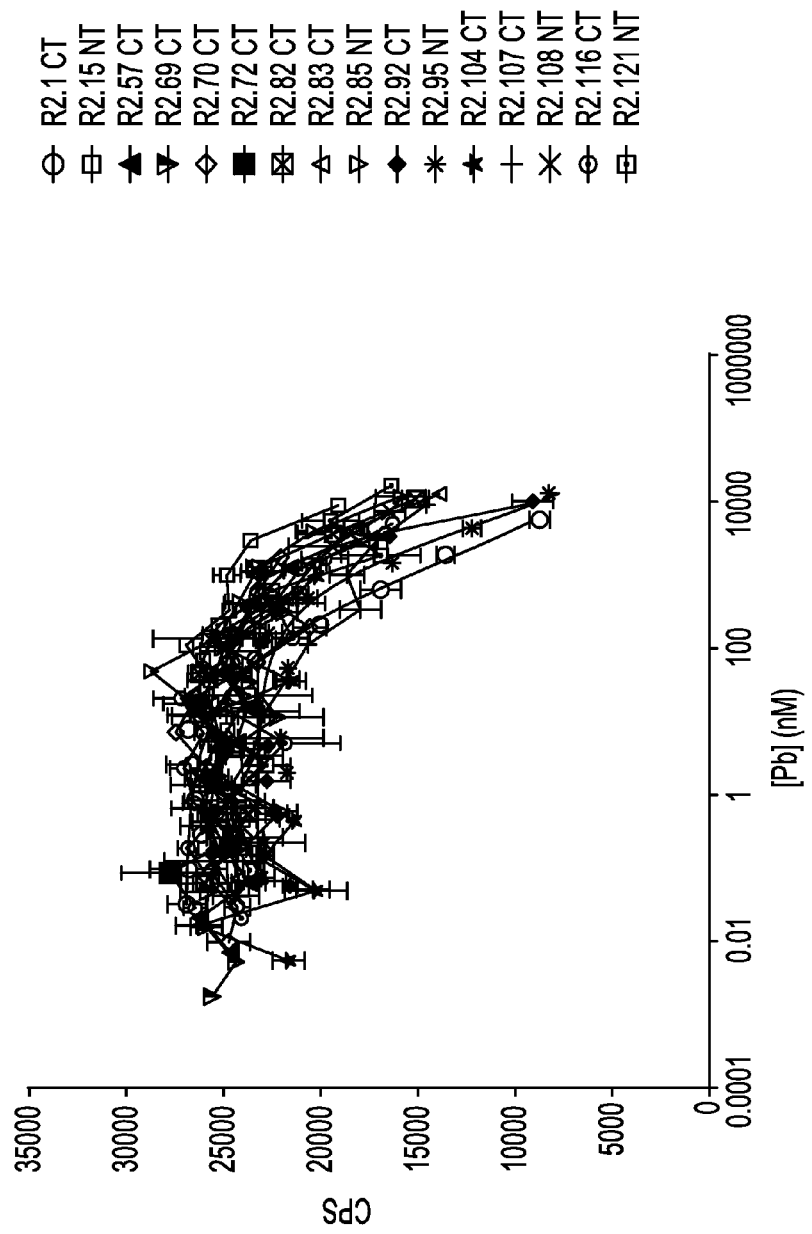

AlphaScreen bn-ratSclerostin/muLRP-6-His Inhibition:
Testing antiSclerostin Peptibodies

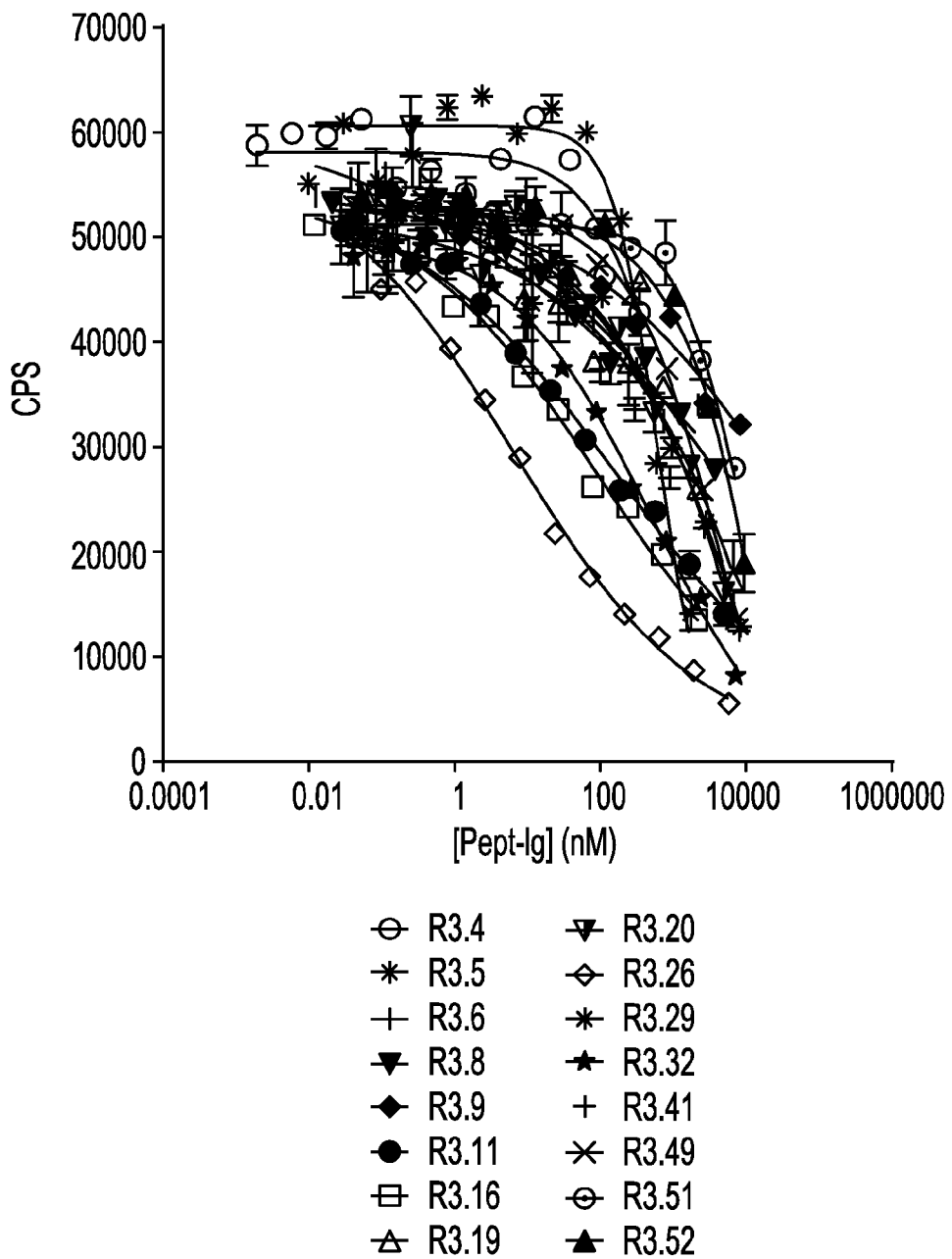

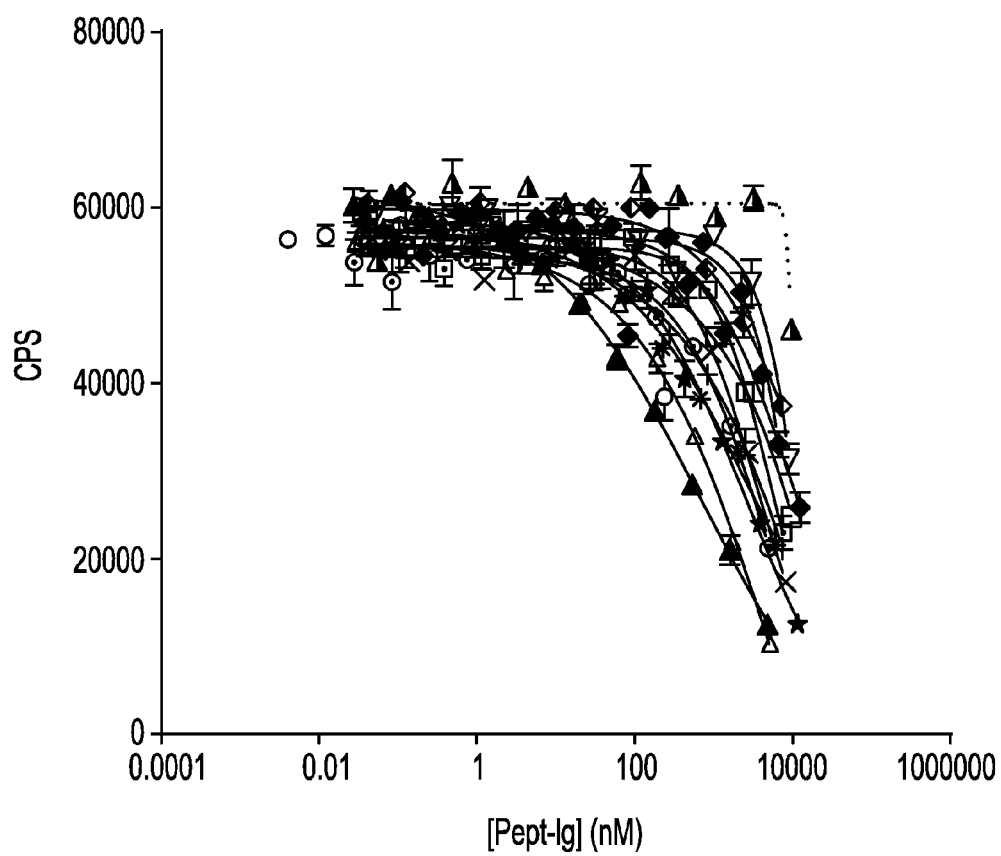

Scl-Peptibodies in Wnt 1 Assay
(against hScl at 0.5ug/ml)

Batch 2 Scl-Peptibodies in Wnt 1 Assay

Matured Pepti-Ig Screening in Wnt 1 Assay
(against hScl)

Groups (n=6/group):
G1=Vehicle (A52 Su)
G2=6.147 (12mg/kg)
G3=Pepti Ig 1X (12.5 mg/kg)
G4=Pepti Ig 2X (12.5 mg/kg)

S.C. dosing every other day

- 10 week old male C57Bl/6 mouse
- Endpoints:
- in-vivo DXA BMD at BL, week 1, 2 and 3
- Serum at BL, week 1, 2 and 3

INHIBITORY POLYPEPTIDES SPECIFIC TO WNT INHIBITORS

This application is a national stage application under 35 U.S.C. §371 of International Application No. PCT/US2014/029388, having an international filing date of Mar. 14, 2014, which claims the benefit of U.S. Provisional Patent Application No. 61/793,143, filed on Mar. 15, 2013 which are hereby incorporated by reference.

TECHNICAL FIELD OF THE INVENTION

The present application is being filed along with a Sequence Listing in electronic format. The Sequence Listing is provided as a file entitled A-1821-US-PCT_SeqList.txt, created Jun. 2, 2015, which is 627 KB in size. The information in the electronic format of the Sequence Listing is incorporated herein by reference in its entirety.

The invention generally relates to methods of making and using peptides or peptibodies for the treatment of disorders associated with low bone mineral density.

BACKGROUND OF THE INVENTION

Sclerostin, an osteocyte-secreted protein, negatively regulates osteoblasts and inhibits bone formation (Am. J. Hum. Genet. 2001 March; 68(3):577-89). Likewise, DKK1 plays a key role in regulating bone development and remodeling (J. Orthop. Res. 2011 March; 29(3):414-8). Both of these molecules regulate the Wnt pathway by inhibiting Wnt activity. Inhibition of these Wnt regulators has been shown to change bone density making them attractive targets for therapeutic intervention to treat diseases and disorders associated with bone loss (J Bone Miner Res. 2011 January; 26(1):19-26; Blood Jul. 9, 2009 vol. 114 no. 2; 371-379).

Thus there is a need in the art to generate additional therapeutics that are stable, have desirable half lives, lack immunogenicity and are capable of high efficiency production that further inhibit sclerostin, DKK1 or both.

SUMMARY OF THE INVENTION

The present invention provides proteins comprising domains that specifically bind to target molecules, polynucleotides encoding the proteins, methods of using such proteins, and methods of identifying monomer domains for use in such proteins. The proteins described herein are now known as avimers. These avimers are contemplated for use alone or in combination with other proteins such as avimers and/or antibodies, or with other drugs. In some embodiments, the monomer domain: is a non-naturally-occurring monomer domain consisting of 30 to 50 amino acids; comprises at least one disulfide bond; and optionally, binds to an ion.

In some embodiments, the monomer domain is an LDL receptor class A monomer domain. In some embodiments, the monomer domain is an LDL receptor class A monomer domain comprising the following sequence: EFXCXNGXCIPXXWXCDGXDDCGDXSDE, wherein X is any amino acid.

In some embodiments, the second monomer domain binds to immunoglobulin (IgG) and the second monomer domain is an LDL receptor class A monomer domain comprising a sequence selected from the following:

CXSSGRCIPXXWVCDGXXDCRDXSDE,
and

CXSSGRCIPXXWLCDGXXDCRDXSDE wherein X is any amino acid.

In some embodiments, the second monomer domain comprises CHPTGQFRCRSSGRCVSPTWVCDGDNDCGDNSDEENC.

In some embodiments, the monomer domains are each between 35 to 45 amino acids.

In some embodiments, each monomer domain comprises two disulfide bonds. In some embodiments, each monomer domain comprises three disulfide bonds.

In some embodiments, the ion is a metal ion. In some embodiments, the ion is a calcium ion.

In some embodiments, at least one of the monomer domains is derived from a LDL-receptor class A domain. In some embodiments, at least one of the monomer domains is derived from an EGF-like domain.

In some embodiments, the monomer comprises an amino acid sequence in which at least 10% of the amino acids in the sequence are cysteine; and/or at least 25% of the amino acids are non-naturally-occurring amino acids.

The present invention also provides methods for identifying a polypeptide that binds to sclerostin or DKK1. In some embodiments, the method comprises, screening a library of polypeptides for affinity to sclerostin or DKK1; and selecting a polypeptide comprising at least one monomer domain that binds to sclerostin or DKK1, wherein the monomer domain: is a non-naturally-occurring monomer domain; comprises at least one disulfide bond; and binds to an ion.

In some embodiments, the selected polypeptide comprises a monomer domain comprising any of the following:

Cxxx[EQ]FxCxSTxRC[IV]xxxWxCDGDNDCEDxSDEx;

Cxxxx[EQ]FECxSTxRC[IV]xxxWxCDGxNDCEDxSDEx;

Cxxxx[EQ]FxCxSTxRC[ILV]PxxWxCDGxxDCEDxSDExx;

Cxxx[EQ]FQCxSTxRC[IV]xxWxCDGxNDCEDSSDExxC;

Cxxxx[EQ]FxCxxxxxC[ILV]xxxxxxxxxxxDCxDxSDEx;

Cxxx[EQ]FxCxSTGRCxPxxWxCxGxNDCEDxSDEx;

Cxxxx[EQ]FxCxSTxRC[ILV]xxxWxCxxxxDCxDxSDxxxxxCx;

Cxxx[EQ]FxCxxxxxC[ILV]xxxWxCDGxNDCxDxSxExxxxC;

Cxxxx[EQ]FxCxSTxRC[ILV]PxxWxCxGxxDCxDxSDEx;

Cxxxx[EQ]FxCxxxxxC[ILV]xxxWxCDGxxDCxDxSDEx;
and

EFXCXNGXCIPXXWXCDGXDDCGDXSDE.

In some embodiments, the method further comprises a step of mutating at least one monomer domain, thereby providing a library comprising mutated monomer domains.

In some embodiments, the library of monomer domains is expressed as a phage display, ribosome display or cell surface display.

In some embodiments, the polypeptide comprises at least two monomer domains and the monomer domains are linked by a linker. In some embodiments, the linker is a peptide linker. In some embodiments, the linker is between 4 to 12 amino acids long.

In some embodiments, at least one of the monomer domains is derived from a LDL-receptor class A domain. In some embodiments, at least one of the monomer domains is derived from an EGF-like domain.

The present invention also provides polynucleotides encoding a polypeptide comprising a monomer domain that binds to sclerostin or DKK1, wherein the monomer domain: is a non-naturally-occurring monomer domain consisting of 30 to 50 amino acids; comprises at least one disulfide bond. The present invention also provides a polypeptide comprising a monomer domain that binds to immunoglobulin-G (IgG), wherein the monomer domain is an LDL receptor class A monomer domain comprising sequence selected from the following:

```
CXSSGRCIPXXWVCDGXXDCRDXSDE,

CXSSGRCIPXXWLCDGXXDCRDXSDE,
and

[EQ]FXCRX[ST]XRC[IV]XCXW[ILV]CDGXXDCXD[DN]SDE
``` wherein X is any amino acid and amino acids in brackets are alternative amino acids at a single position; and wherein the polypeptide has an increased serum half-life when the polypeptide is injected into an animal compared to the serum half-life of a polypeptide lacking the monomer domain that binds to IgG.

In some embodiments, the monomer domain comprises CHPTGQFRCRSSGRCVSPTWVCDGDNDCGDNS-DEENCSAPASEPPGSL.

In some embodiments, the monomer domain comprises HPTGQFRCRSSGRCVSPTWVCDGDNDCGDNS-DEENC.

In some embodiments, the polypeptide comprises a second monomer domain with binding specificity for a molecule other than IgG, wherein the second monomer domain: has between 30-100 amino acids; is a non-naturally-occurring monomer domain; comprises at least one disulfide bond.

In some embodiments, the second monomer domain is a non-naturally-occurring LDL-receptor class A domain.

In some embodiments, the Avimer is fused to an antibody or a fragment thereof, e.g., an Fc domain.

BRIEF DESCRIPTION OF THE FIGURES

FIG. 3: Representative Avimer walked dimers neutralize Sclerostin in AlphaScreen assays.

FIG. 7: Yeast Display Avimer monomers and dimers neutralize Sclerostin in AlphaScreen assays.

FIG. 9: Representative Avimer New walked dimers neutralize Sclerostin in the Wnt1 cell based assay.

FIG. 10: Avimer New WD17- and WD25-antibody fusions neutralize Sclerostin in AlphaScreen assays.

FIG. 14: Top Seven Avimer-antibody fusions block both Sclerostin and Dkk-1 simultaneously in a Wnt1 cell based assay.

FIG. 25: Representative second round affinity matured Avimers neutralize human Dkk-1 in the Wnt1 cell based assay.

FIG. 27A-D: LRP-6 competition AlphaScreen assay of anti-SOST peptibodies from primary screen.

DETAILED DESCRIPTION OF THE INVENTION

Figure 1A:
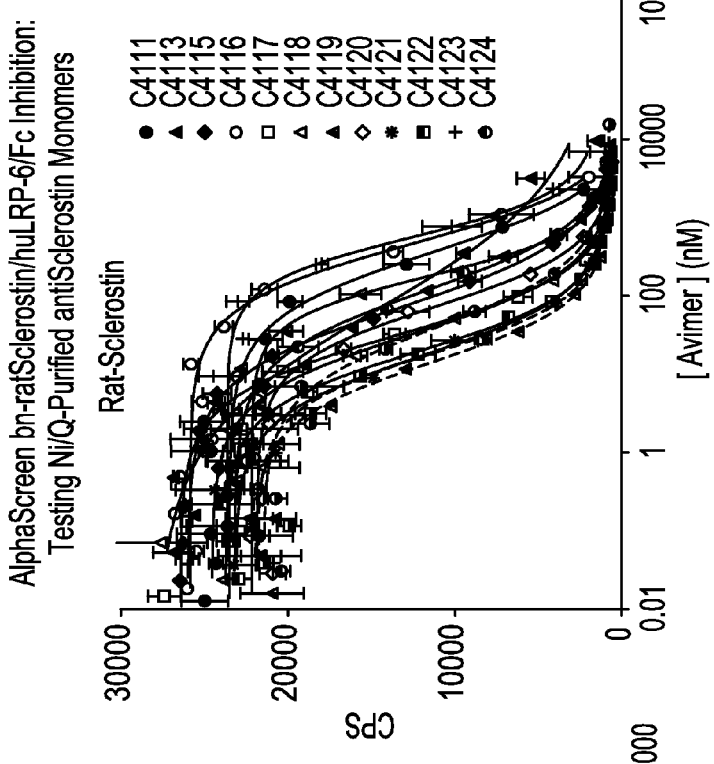
FIG. 1: Representative Sclerostin neutralizing naive Avimer monomers in AlphaScreen.

The present description is based on the discovery of peptide sequences capable of binding either sclerostin or DKK1, or both and the construction of polypeptides using these peptides to generate avimers for use in treating conditions associated with bone loss and fracture healing.

The terms "monomer domain" or "monomer" are used interchangeably and herein refer to a discrete region found in a protein or polypeptide. A monomer domain forms a native three-dimensional structure in solution in the absence of flanking native amino acid sequences. Monomer domains of the invention will often bind to a target molecule. For example, a polypeptide that forms a three-dimensional structure that binds to a target molecule is a monomer domain. As used herein, the term "monomer domain" does not encompass the complementarity determining region (CDR) of an antibody.

The term "loop" refers to that portion of a monomer domain that is typically exposed to the environment by the assembly of the scaffold structure of the monomer domain protein, and which is involved in target binding. The present invention provides three types of loops that are identified by specific features, such as, potential for disulfide bonding, bridging between secondary protein structures, and molecular dynamics (i.e., flexibility). The three types of loop sequences are a cysteine-defined loop sequence, a structure-defined loop sequence, and a B-factor-defined loop sequence.

As used herein, the term "cysteine-defined loop sequence" refers to a subsequence of a naturally occurring monomer domain-encoding sequence that is bound at each end by a cysteine residue that is conserved with respect to at least one other naturally occurring monomer domain of the same family. Cysteine-defined loop sequences are identified by multiple sequence alignment of the naturally occurring monomer domains, followed by sequence analysis to identify conserved cysteine residues. The sequence between each consecutive pair of conserved cysteine residues is a cysteine-defined loop sequence. The cysteine-defined loop sequence does not include the cysteine residues adjacent to each terminus. Monomer domains having cysteine-defined loop sequences include the LDL receptor A-domains, EGF-like domains, sushi domains, Fibronectin type 1 domains, and the like. Thus, for example, in the case of LDL receptor A-domains represented by the consensus sequence, $CX_6CX_4CX_6CX_5CX_8C$, wherein $X_6$, $X_4$, $X_5$, and $X_8$ each represent a cysteine-defined loop sequence comprising the designated number of amino acids.

As used herein, the term "structure-defined loop sequence" refers to a subsequence of a monomer-domain encoding sequence that is bound at each end to subsequences that each form a secondary structure. Secondary structures for proteins with known three dimensional structures are identified in accordance with the algorithm STRIDE for assigning protein secondary structure as described in Frishman, D. and Argos, P. (1995) "Knowledge-based secondary structure assignment," Proteins, 23(4):566-79. Secondary structures for proteins with unknown or uncharacterized three dimensional structures are identified in accordance with the algorithm described in Jones, D. T. (1999), "Protein secondary structure prediction based on position-specific scoring matrices," J. Mol. Biol., 292:195-202 (see also McGuffin, L. J., Bryson, K., Jones, D. T. (2000) "The PSIPRED protein structure prediction server," Bioinformatics, 16:404-405. Secondary structures include, for example, pleated sheets, helices, and the like. Examples of monomer domains having structure-defined loop sequences are the C2 domains, Ig domains, Factor 5/8 C domains, Fibronectin type 3 domains, and the like.

The term "B-factor-defined loop sequence" refers to a subsequence of at least three amino acid residues of a monomer-domain encoding sequence in which the B-factors for the alpha carbons in the B-factor-defined loop are among the 25% highest alpha carbon B factors in the entire monomer domain. Typically the average alpha-carbon B-factor for the subsequence is at least about 65. As used herein, the term "B-factor" (or "temperature factor" or "Debye-Waller factor") is derived from X-ray scattering data. The B-factor is a factor that can be applied to the X-ray scattering term for each atom, or for groups of atoms, that describes the degree to which electron density is spread out B-factors employed in the practice of the present invention may be either isotropic or anisotropic.

The term "multimer" is used herein to indicate a polypeptide comprising at least two monomer domains. The separate monomer domains in a multimer can be joined together by a linker. A multimer is also known as a combinatorial mosaic protein or a recombinant mosaic protein.

The term "linker" is used herein to indicate a moiety or group of moieties that joins or connects two or more discrete separate monomer domains. The linker allows the discrete separate monomer domains to remain separate when joined together in a multimer. The linker moiety is typically a substantially linear moiety. Suitable linkers include polypeptides, polynucleic acids, peptide nucleic acids and the like. Suitable linkers also include optionally substituted alkylene moieties that have one or more oxygen atoms incorporated in the carbon backbone. Typically, the molecular weight of the linker is less than about 2000 daltons. More typically, the molecular weight of the linker is less than about 1500 daltons and usually is less than about 1000 daltons. The linker can be small enough to allow the discrete separate monomer domains to cooperate, e.g., where each of the discrete separate monomer domains in a multimer binds to the same target molecule via separate binding sites. Exemplary linkers include a polynucleotide encoding a polypeptide, or a polypeptide of amino acids or other non-naturally occurring moieties. The linker can be a portion of a native sequence, a variant thereof, or a synthetic sequence. Linkers can comprise, e.g., naturally occurring, non-naturally occurring amino acids, or a combination of both.

As used herein, "directed evolution" refers to a process by which polynucleotide variants are generated, expressed, and screened for an activity (e.g., a polypeptide with binding activity) in a recursive process. One or more candidates in the screen are selected and the process is then repeated using polynucleotides that encode the selected candidates to generate new variants. Directed evolution involves at least two rounds of variation generation and can include 3, 4, 5, 10, 20 or more rounds of variation generation and selection. Variation can be generated by any method known to those of skill in the art, including, e.g., by error-prone PCR, gene recombination, chemical mutagenesis and the like.

The term "shuffling" is used herein to indicate recombination between non-identical sequences. In some embodiments, shuffling can include crossover via homologous recombination or via non-homologous recombination, such as via cre/lox and/or flp/frt systems. Shuffling can be carried out by employing a variety of different formats, including for example, in vitro and in vivo shuffling formats, in silico shuffling formats, shuffling formats that utilize either double-stranded or single-stranded templates, primer based shuffling formats, nucleic acid fragmentation-based shuffling formats, and oligonucleotide-mediated shuffling formats, all of which are based on recombination events between non-identical sequences and are described in more detail or referenced herein below, as well as other similar recombination-based formats. The term "random" as used herein refers to a polynucleotide sequence or an amino acid sequence composed of two or more amino acids and constructed by a stochastic or random process. The random polynucleotide sequence or amino acid sequence can include framework or scaffolding motifs, which can comprise invariant sequences.

The term "pseudorandom" as used herein refers to a set of sequences, polynucleotide or polypeptide, that have limited variability, so that the degree of residue variability at some positions is limited, but any pseudorandom position is allowed at least some degree of residue variation.

Peptides are typically cleared quickly from the serum limiting their usefulness, accordingly the avimers herein also have the benefit of additional modifications resulting in extended serum half life. Thus in certain embodiments, the avimers of the invention have modifications to improve serum half life including fusions to antibodies or parts of the antibody (e.g., Fc domain fusions). It is contemplated that one of skill in the art will appreciate that other methods can be employed to extend serum half life for the peptides of the invention, including but not limited to the use of polysaccharides or other polymers such as polyethylene gycol (PEG) attachment to the peptides.

Fc fusions described herein can comprise any constant region. The heavy chain constant region can be, for example, an alpha-, delta-, epsilon-, gamma-, or mu-type heavy chain constant region, e.g., a human alpha-, delta-, epsilon-, gamma-, or mu-type heavy chain constant region. In one embodiment the light or heavy chain constant region is a fragment, derivative, variant, or mutein of a naturally-occurring constant region.

As used herein, the term "framework" or "framework sequence" refers to the region or sequence of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, represents the combined FR's within the variable region of a single, naturally occurring immunoglobulin chain. As used herein, a FR represents one of the four sub-regions, and FRs represents two or more of the four sub-regions constituting a framework region.

"Substituting" or "substitution of" an amino acid refers to substituting the original amino acid residue for one or more other amino acid residue(s).

It is contemplated that essentially any antibody variable domain may be incorporated into the polypeptide format described herein. Exemplary antibody variable domains (and the antigen to which they specifically bind) include, but are not limited to, those described in U.S. Pat. No. 7,947,809 and U.S. Patent Application Publication No. 20090041784 (glucagon receptor), U.S. Pat. Nos. 7,939,070, 7,833,527, 7,767,206, and 7,786,284 (IL-17 receptor A), U.S. Pat. Nos. 7,872,106 and 7,592,429 (Sclerostin), U.S. Pat. Nos. 7,871, 611, 7,815,907, 7,037,498, 7,700,742, and U.S. Patent Application Publication No. 20100255538 (IGF-1 receptor), U.S. Pat. No. 7,868,140 (B7RP1), U.S. Pat. No. 7,807,159 and U.S. Patent Application Publication No. 20110091455 (myostatin), U.S. Pat. Nos. 7,736,644, 7,628,986 ,7,524,496, and U.S. Patent Application Publication No. 20100111979 (deletion mutants of epidermal growth factor receptor), U.S. Pat. No. 7,728,110 (SARS coronavirus), U.S. Pat. No. 7,718,776 and U.S. Patent Application Publication No. 20100209435 (OPGL), U.S. Pat. Nos. 7,658,924 and 7,521, 053 (Angiopoietin-2), U.S. Pat. Nos. 7,601,818 , 7,795,413, U.S. Patent Application Publication No. 20090155274, U.S. Patent Application Publication No. 20110040076 (NGF), U.S. Pat. No. 7,579,186 (TGF-β type II receptor), U.S. Pat. No. 7,541,438 (connective tissue growth factor), U.S. Pat. No. 7,438,910 (IL1-R1), U.S. Pat. No. 7,423,128 (properdin), U.S. Pat. Nos. 7,411,057, 7,824,679, 7,109,003, 6,682, 736, 7,132,281, and 7,807,797 (CTLA-4), U.S. Pat. Nos. 7,084,257, 7,790,859, 7,335,743, 7,084,257, and U.S. Patent Application Publication No. 20110045537 (interferon-gamma), U.S. Pat. No. 7,932,372 (MAdCAM), U.S. Pat. No. 7,906,625, U.S. Patent Application Publication No. 20080292639, and U.S. Patent Application Publication No. 20110044986 (amyloid), U.S. Pat. Nos. 7,815,907 and 7,700,742 (insulin-like growth factor I), U.S. Pat. Nos. 7,566,772 and 7,964,193 (interleukin-1β), U.S. Pat. Nos. 7,563,442, 7,288,251, 7,338,660, 7,626,012, 7,618,633, and U.S. Patent Application Publication No. 20100098694 (CD40), U.S. Pat. No. 7,498,420 (c-Met), U.S. Pat. Nos. 7,326,414, 7,592,430, and 7,728,113 (M-CSF), U.S. Pat. Nos. 6,924,360, 7,067,131, and 7,090,844 (MUC18), U.S. Pat. Nos. 6,235,883, 7,807,798, and U.S. Patent Application Publication No. 20100305307 (epidermal growth factor receptor), U.S. Pat. Nos. 6,716,587, 7,872,113, 7,465,450, 7,186,809, 7,317,090, and 7,638,606 (interleukin-4 receptor), U.S. Patent Application Publication No. 20110135657 (BETA-KLOTHO), U.S. Pat. Nos. 7,887,799 and 7,879,323 (fibroblast growth factor-like polypeptides), U.S. Pat. No. 7,867,494 (IgE), U.S. Patent Application Publication No. 20100254975 (ALPHA-4 BETA-7), U.S. Patent Application Publication No. 20100197005 and U.S. Pat. No. 7,537,762 (ACTIVIN RECEPTOR-LIKE KINASE-1), U.S. Pat. No. 7,585,500 and U.S. Patent Application Publication No. 20100047253 (IL-13), U.S. Patent Application Publication No. 20090263383 and U.S. Pat. No. 7,449,555 (CD148), U.S. Patent Application Publication No. 20090234106 (ACTIVIN A), U.S. Patent Application Publication No. 20090226447 (angiopoietin-1 and angiopoietin-2), U.S. Patent Application Publication No. 20090191212 (Angiopoietin-2), U.S. Patent Application Publication No. 20090155164 (C-FMS), U.S. Pat. No. 7,537,762 (activin receptor-like kinase-1), U.S. Pat. No. 7,371,381 (galanin), U.S. Patent Application Publication No. 20070196376 (INSULIN-LIKE GROWTH FACTORS), U.S. Pat. Nos. 7,267, 960 and 7,741,115 (LDCAM), U.S. Pat. No. 7,265,212 (CD45RB), U.S. Pat. No. 7,709,611, U.S. Patent Application Publication No. 20060127393 and U.S. Patent Application Publication No. 20100040619 (DKK1), U.S. Pat. No. 7,807, 795, U.S. Patent Application Publication No. 20030103978 and U.S. Pat. No. 7,923,008 (osteoprotegerin), U.S. Patent Application Publication No. 20090208489 (OV064), U.S. Patent Application Publication No. 20080286284 (PSMA), U.S. Pat. No. 7,888,482, U.S. Patent Application Publication No. 20110165171, and U.S. Patent Application Publication No. 20110059063 (PAR2), U.S. Patent Application Publication No. 20110150888 (HEPCIDIN), U.S. Pat. No. 7,939, 640 (B7L-1), U.S. Pat. No. 7,915,391 (c-Kit), U.S. Pat. Nos. 7,807,796 7,193,058, and 7,427,669 (ULBP), U.S. Pat. Nos. 7,786,271, 7,304,144, and U.S. Patent Application Publication No. 20090238823 (TSLP), U.S. Pat. No. 7,767,793 (SIGIRR), U.S. Pat. No. 7,705,130 (HER-3), U.S. Pat. No. 7,704,501 (ataxin-1-like polypeptide), U.S. Pat. Nos. 7,695, 948 and 7,199,224 (TNF-α converting enzyme), U.S. Patent Application Publication No. 20090234106 (ACTIVIN A), U.S. Patent Application Publication No. 20090214559 and U.S. Pat. No. 7,438,910 (IL1-R1), U.S. Pat. No. 7,579,186 (TGF-β type II receptor), U.S. Pat. No. 7,569,387 (TNF receptor-like molecules), U.S. Pat. No. 7,541,438, (connective tissue growth factor), U.S. Pat. No. 7,521,048 (TRAIL receptor-2), U.S. Pat. Nos. 6,319,499, 7,081,523, and Patent Application Publication No. 20080182976 (erythropoietin receptor), U.S. Patent Application Publication No. 20080166352 and U.S. Pat. No. 7,435,796 (B7RP1), U.S. Pat. No. 7,423,128 (properdin), U.S. Pat. Nos. 7,422,742 and 7,141,653 (interleukin-5), U.S. Pat. Nos. 6,740,522 and 7,411,050 (RANKL), U.S. Pat. No. 7,378,091 (carbonic anhydrase IX (CA IX) tumor antigen), U.S. Pat. Nos. 7,318,925 and 7,288,253 (parathyroid hormone), U.S. Pat. No. 7,285,269 (TNF), U.S. Pat. Nos. 6,692,740 and 7,270,817 (ACPL), U.S. Pat. No. 7,202,343 (monocyte chemoattractant protein-1), U.S. Pat. No. 7,144,731 (SCF), U.S. Pat. Nos. 6,355,779 and 7,138,500 (4-1BB), U.S. Pat. No. 7,135,174 (PDGFD), U.S. Pat. Nos. 6,630,143 and 7,045,128 (Flt-3 ligand), U.S. Pat. No. 6,849,450 (metalloproteinase inhibitor), U.S. Pat. No. 6,596,852 (LERK-5), U.S. Pat. No. 6,232,447 (LERK-6), U.S. Pat. No. 6,500,429 (brain-derived neurotrophic factor), U.S. Pat. No. 6,184,359 (epithelium-derived T-cell factor), U.S. Pat. No. 6,143,874 (neurotrophic factor NNT-1), U.S. Patent Application Publication No. 20110027287 (PROPROTEIN CONVERTASE SUBTILISIN KEXIN TYPE 9 (PCSK9)), U.S. Patent Application Publication No. 20110014201 (IL-18 RECEPTOR), and U.S. Patent Application Publication No. 20090155164 (C-FMS). The above patents and published patent applications are incorporated herein by reference in their entirety for purposes of their disclosure of variable domain polypeptides, variable domain encoding nucleic acids, host cells, vectors, methods of making polypeptides encoding said variable domains, pharmaceutical compositions, and methods of treating diseases associated with the respective target of the variable domain-containing antigen binding protein or antibody.

The Avimers described herein, in some embodiments, may further comprise sclerostin and/or DKK1 antibodies or fragments thereof (e.g., a polypeptide comprising a heavy and light chain that mediates binding to sclerostin and a heavy and light chain that mediates binding to DKK1). The term "antibody" refers to an intact antibody, or a binding fragment thereof. An antibody may comprise a complete antibody (immunoglobulin) molecule (including polyclonal, monoclonal, chimeric, humanized, and/or human versions having full length heavy and/or light chains), or comprise an antigen binding fragment thereof. Antibody fragments include F(ab')$_2$, Fab, Fab', Fv, Fc, and Fd fragments, and can be incorporated into single domain antibodies (e.g., nanobodies), single-chain antibodies, maxibodies, minibodies, intrabodies, diabodies, triabodies, tetrabodies, v-NAR and bis-scFv (see, e.g., Hollinger and Hudson, *Nature Biotechnology*, 23(9):1126-1136 (2005)). Antibody polypeptides, including fibronectin polypeptide monobodies, also are disclosed in U.S. Pat. No. 6,703,199. Other antibody polypeptides are disclosed in U.S. Patent Publication No. 20050238646.

An antibody fragment may be a synthetic or genetically engineered protein. For example, antibody fragments include isolated fragments consisting of the light chain variable region, "Fv" fragments consisting of the variable regions of the heavy and light chains, and recombinant single chain polypeptide molecules in which light and heavy variable regions are connected by a peptide linker (scFv proteins).

Another form of an antibody fragment is a peptide comprising one or more complementarity determining regions (CDRs) of an antibody. As used herein, the term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia & Lesk, J. Mol. Biol. 196:901-917 (1987) and Chothia et al., Nature 342:877-883 (1989)) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (FASEB J. 9:133-139 (1995)) and MacCallum (J Mol Biol 262(5): 73245 (1996)). Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although preferred embodiments use Kabat or Chothia defined CDRs.

CDRs (also termed "minimal recognition units" or "hypervariable region") are obtained by, e.g., constructing polynucleotides that encode the CDR of interest. Such polynucleotides are prepared, for example, by using the polymerase chain reaction to synthesize the variable region using mRNA of antibody-producing cells as a template (see, for example, Larrick et al., *Methods: A Companion to Methods in Enzymology*, 2:106 (1991); Courtenay-Luck, "Genetic Manipulation of Monoclonal Antibodies," in *Monoclonal Antibodies Production, Engineering and Clinical Application*, Ritter et al. (eds.), page 166, Cambridge University Press (1995); and Ward et al., "Genetic Manipulation and Expression of Antibodies," in *Monoclonal Antibodies: Principles and Applications*, Birch et al., (eds.), page 137, Wiley-Liss, Inc. (1995)).

"Specifically binds" as used herein means that the binding portion of an avimer preferentially binds a target protein or peptide at a higher affinity over other proteins or peptides. In some embodiments "specifically binds" means binding at a higher affinity for the target protein than for other proteins. Avimers that specifically bind a protein or peptide may have a binding affinity of less than or equal to $1 \times 10^{-7}$ M, less than or equal to $2 \times 10^{-7}$ M, less than or equal to $3 \times 10^{-7}$ M, less than or equal to $4 \times 10^{-7}$ M, less than or equal to $5 \times 10^{-7}$ M, less than or equal to $6 \times 10^{-7}$ M, less than or equal to $7 \times 10^{-7}$ M, less than or equal to $8 \times 10^{-7}$ M, less than or equal to $9 \times 10^{-7}$ M, less than or equal to $1 \times 10^{-8}$ M, less than or equal to $2 \times 10^{-8}$ M, less than or equal to $3 \times 10^{-8}$ M, less than or equal to $4 \times 10^{-8}$ M, less than or equal to $5 \times 10^{-8}$ M, less than or equal to $6 \times 10^{-8}$ M, less than or equal to $7 \times 10^{-8}$ M, less than or equal to $8 \times 10^{-8}$ M, less than or equal to $9 \times 10^{-8}$ M, less than or equal to $1 \times 10^{-9}$ M, less than or equal to $2 \times 10^{-9}$ M, less than or equal to $3 \times 10^{-9}$ M, less than or equal to $4 \times 10^{-9}$ M, less than or equal to $5 \times 10^{-9}$ M, less than or equal to $6\times10^{-9}$ M, less than or equal to $7\times10^{-9}$ M, less than or equal to $8\times10^{-9}$ M, less than or equal to $9\times10^{-9}$ M, less than or equal to $1\times10^{-10}$ M, less than or equal to $2\times10^{-10}$ M, less than or equal to $3\times10^{-10}$ M, less than or equal to $4\times10^{-10}$ M, less than or equal to $5\times10^{-10}$ M, less than or equal to $6\times10^{-10}$ M, less than or equal to $7\times10^{-10}$ M, less than or equal to $8\times10^{-10}$ M, less than or equal to $9\times10^{-10}$ M, less than or equal to $1\times10^{-11}$ M, less than or equal to $2\times10^{-11}$ M, less than or equal to $3\times10^{-11}$ M, less than or equal to $4\times10^{-11}$ M, less than or equal to $5\times10^{-11}$ M, less than or equal to $6\times10^{-11}$ M, less than or equal to $7\times10^{-11}$ M, less than or equal to $8\times10^{-11}$ M, less than or equal to $9\times10^{-11}$ M, less than or equal to $1\times10^{-12}$ M, less than or equal to $2\times10^{-12}$ M, less than or equal to $3\times10^{-12}$ M, less than or equal to $4\times10^{-12}$ M, less than or equal to $5\times10^{-12}$ M, less than or equal to $6\times10^{-12}$ M, less than or equal to $7\times10^{-12}$ M, less than or equal to $8\times10^{-12}$ M, or less than or equal to $9\times10^{-12}$ M.

Sclerostin Avimers

In some embodiments, the polypeptide described herein comprises a sclerostin binding portion comprising an Avimer specific for sclerostin. Sclerostin, the product of the SOST gene, is absent in sclerosteosis, a skeletal disease characterized by bone overgrowth and strong dense bones (Brunkow et al., Am. J. Hum. Genet., 68:577-589 (2001); Balemans et al., Hum. Mol. Genet., 10:537-543 (2001)). The amino acid sequence of human sclerostin is reported by Brunkow et al. and is disclosed in U.S. Pat. No. 6,803,453 as SEQ ID NO: 2 (MQLPLALCLV CLLVHTAPRV VEG QGWQAPKNDA TEIIPELGEY PEPPPELENN KTMN-RAEMGG RPPHHPFETK DVSEYSCREL HPTRYVT-DGP CRSAKPVTEL VCSGQCGPARLLPNA IGRGKW-WRPS GPDFRCIPDRYRAQR VQLLCPGGEA PRARKVRLVA SCKCRLTRF HNQSELKDFG TEAAR-PQKGRKPRPRARSAK ANQAELENAY) (which patent publication is incorporated in its entirety for its description of sclerostin binding agents and Sequence Listing). Recombinant human sclerostin/SOST is commercially available from R&D Systems (Minneapolis, Minn., USA; 2006 Catalog #1406-ST-025). Additionally, recombinant mouse sclerostin/SOST is commercially available from R&D Systems (Minneapolis, Minn., USA; 2006 Catalog #1589-ST-025). Research grade sclerostin-binding monoclonal antibodies are commercially available from R&D Systems (Minneapolis, Minn., USA; mouse monoclonal: 2006 Catalog # MAB1406; rat monoclonal: 2006 Catalog # MAB1589). U.S. Pat. Nos. 6,395,511 and 6,803,453, and U.S. Patent Publication Nos. 2004/0009535 and 2005/0106683 refer to sclerostin antibodies generally. Examples of sclerostin binding agents suitable for use in the context of the invention also are described in U.S. Patent Publication Nos. 2007/0110747 and 2007/0072797, which are hereby incorporated by reference. Additional information regarding materials and methods for generating sclerostin binding agents can be found in U.S. Patent Publication No. 20040158045 (hereby incorporated by reference).

Sclerostin Avimers may bind to mature human sclerostin, or a naturally occurring variant thereof, with an affinity ($K_D$) of less than or equal to $1\times10^{-7}$ M, less than or equal to $1\times10^{-8}$ M, less than or equal to $1\times10^{-9}$ M, less than or equal to $1\times10^{-10}$ M, less than or equal to $1\times10^{-11}$ M, or less than or equal to $1\times10^{-12}$ M. Affinity is determined using a variety of techniques, an example of which is an affinity ELISA assay. In various embodiments, affinity is determined by a BIAcore assay. In various embodiments, affinity is determined by a kinetic method. In various embodiments, affinity is determined by an equilibrium/solution method. U.S. Patent Publication No. 2007/0110747 contains additional description of affinity assays suitable for determining the affinity ($K_D$).

In some or any embodiments, the sclerostin Avimer binds to a sclerostin polypeptide comprising the amino acid sequence set forth in the mature human sclerostin sequence and binds a region of sclerostin comprising the sequence of (CGPARLLPNAIGRGKWWRPSGPDFRC; corresponding to amino acids 86-111 mature human sclerostin). This region is also referred to herein as the "loop 2" region of sclerostin. Regions of sclerostin outside of the loop 2 region are defined herein as "non-loop 2 regions." Alternatively or in addition, the sclerostin Avimer binds to a sclerostin polypeptide comprising amino acids 57-146 mature human sclerostin. Alternatively or in addition, the sclerostin Avimer binds to a sclerostin polypeptide comprising amino acids 89-103 mature human sclerostin and/or amino acids 137-151 mature human sclerostin. Alternatively or in addition, the sclerostin Avimer binds to a sclerostin polypeptide comprising the amino acid sequence set forth in the mature human sclerostin sequence and binds the sequence of at least one of DVSEYSCRELHFTR; corresponding to amino acids 51-64 mature human sclerostin, SAKPVTELVCSGQCGPAR; corresponding to amino acids 73-90 mature human sclerostin, WWRPSGPDFRCIPDRYR; corresponding to amino acids 101-117 mature human sclerostin, LVASCKCKRLTR; corresponding to amino acids 138-149 mature human sclerostin, SAKPVTELVCSGQC; corresponding to amino acids 73-86 mature human sclerostin, LVASCKC; corresponding to amino acids 138-144 mature human sclerostin, C1RELHFTR; corresponding to amino acids 57-64 mature human sclerostin, or CIPDRYR; corresponding to amino acids 111-117 mature human sclerostin within mature human sclerostin. For example, in one aspect, the sclerostin Avimer binds a sub-region of sclerostin mature human sclerostin comprising the foregoing sequences in this paragraph, optionally in its native three-dimensional conformation. Optionally, the sclerostin Avimer binds a peptide consisting of one or more of the foregoing sequences in this paragraph.

In some or any embodiments, the sclerostin Avimer binds to a sclerostin polypeptide comprising amino acids 89-103 and 137-151 mature human sclerostin.

Optionally, the sclerostin Avimer binds a peptide consisting essentially of the amino acid positions 57 and 111 with reference to mature human sclerostin, and has (a) a disulfide bond at amino acid positions 82 and 142, and (b) a disulfide bond at amino acid positions 86 and 144.

Optionally, the sclerostin Avimer binds to a polypeptide consisting essentially of a multiply truncated human sclerostin protein mature human sclerostin, wherein (a) amino acids 1-50, 65-72, 91-100, 118-137, and 150-190 mature human sclerostin are absent from said polypeptide or (b) amino acids 1-56, 65-72, 87-110, 118-137, and 145-190 of mature human sclerostin are absent from said polypeptide.

In some or any embodiments, the sclerostin Avimer binds to a polypeptide having the amino acid sequences of positions 57 and 111 with reference mature human sclerostin, and are joined by at least one of (a) a disulfide bond at amino acid positions 82 and 142 with reference to mature human sclerostin, and (b) a disulfide bond at amino acid positions 86 and 144 with reference to mature human sclerostin.

In some or any embodiments, the sclerostin polypeptide retains the tertiary structure of the corresponding polypeptide region of human sclerostin of mature human sclerostin.

In some or any embodiments, the sclerostin Avimer binds to (i) a portion of human sclerostin comprising amino acids 51-64, 73-90, 101-117, and 138-149 mature human sclerostin, wherein said portion has at least one, at least two or all three of: (a) a disulfide bond between amino acids 57 and 111; (b) a disulfide bond between amino acids 82 and 142; and (c) a disulfide bond between amino acids 86 and 144; or (ii) a portion of human sclerostin comprising amino acids 57-64, 73-86, 111-117, and 138-144 mature human sclerostin, wherein said portion has at least one, at least two, or all three of: (a) a disulfide bond between amino acids 57 and 111; (b) a disulfide bond between amino acids 82 and 142; and (c) a disulfide bond between amino acids 86 and 144.

In various aspects, the sclerostin Avimer is also capable of neutralizing human sclerostin in a MC3T3 cell-based mineralization assay. Mineralization by osteoblast-lineage cells in culture, either primary cells or cell lines, is used as an in vitro model of bone formation. An exemplary cell-based mineralization assay is described in U.S. Patent Publication No. 20070110747 at, e.g., Example 8 (hereby incorporated by reference). MC3T3-E1 cells (Sudo et al., J. Cell Biol., 96:191-198 (1983)) and subclones of the original cell line can form mineral in culture upon growth in the presence of differentiating agents. Such subclones include MC3T3-E1-BF (Smith et al., J. Biol. Chem., 275:19992-20001 (2000)). For both the MC3T3-E1-BF subclone as well as the original MC3T3-E1 cells, sclerostin can inhibit one or more of the sequence of events leading up to and including mineral deposition (i.e., sclerostin inhibits mineralization). Sclerostin antibodies that are able to neutralize sclerostin's inhibitory activity allow for mineralization of the culture in the presence of sclerostin such that there is a statistically significant increase in, e.g., deposition of calcium phosphate (measured as calcium) as compared to the amount of calcium measured in the sclerostin-only treatment group.

When running the assay with the goal of determining whether a particular sclerostin Avimer (or other sclerostin inhibitor) can neutralize sclerostin, the amount of sclerostin used in the assay desirably is the minimum amount of sclerostin that causes at least a 70%, statistically significant, reduction in deposition of calcium phosphate (measured as calcium) in the sclerostin-only group, as compared to the amount of calcium measured in the no sclerostin group. A sclerostin neutralizing Avimer is defined as one that causes a statistically significant increase in deposition of calcium phosphate (measured as calcium) as compared to the amount of calcium measured in the sclerostin-only treatment group. To determine whether an sclerostin Avimer is neutralizing or not, the amount of sclerostin Avimer used in the assay needs to be such that there is an excess of moles of sclerostin binding sites per well as compared to the number of moles of sclerostin per well. Depending on the potency of the Avimer, the fold excess that may be required can be 24, 18, 12, 6, 3, or 1.5, and one of skill is familiar with the routine practice of testing more than one concentration of binding agent.

The sclerostin Avimer optionally has an IC50 of 100 nM or less, or 75 nM or less, or 50 nM or less, or 25 nM or less for neutralizing human sclerostin in a cell-based assay, such as a bone specific alkaline phosphatase assay, e.g., the bone specific alkaline phosphatase assay described in International Patent Publication No. WO 2008/115732 and U.S. Pat. No. 7,744,874 (incorporated herein by reference in its entirety for its description of cell-based assays and sclerostin antibodies). The bone specific alkaline phosphatase assay is predicated on the ability of sclerostin to decrease BMP-4 and Wnt3a-stimulated alkaline phosphatase levels in the multipotential murine cell line, C2C12. According to WO 2008/115732, a neutralizing sclerostin Avimer mediates a dose-dependent increase of alkaline phosphatase activity in this assay.

Alternatively or in addition, the sclerostin Avimer has an IC50 of 100 nM or less (e.g., 75 nM or less, or 50 nM or less) for neutralizing human sclerostin in a cell-based Wnt signaling assay in HEK293 cell lines, such as the Wnt assay involving Wnt1-mediated induction of STF reporter gene described in e.g., International Patent Publication No. WO 2009/047356 (incorporated by reference for its discussion of sclerostin antibodies and cell-based assays). Alternatively or in addition, the sclerostin Avimer has an IC50 of 500 nM or less (e.g., 250 nM or less, 150 nM or less, 100 nM or less, or 50 nM or less) for neutralizing human sclerostin in a BMP2-induced mineralization assay in MC3T3 cells, such as the mineralization assay described in e.g., International Patent Publication No. WO 2009/047356.

Examples of sclerostin antibodies suitable for use in the context of the invention are described in U.S. Patent Publication Nos. 2007/0110747 and 2007/0072797, which are hereby incorporated by reference. In some embodiments, the sclerostin Avimer cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747) to sclerostin. Alternatively or in addition, the sclerostin Avimer is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747). The terms "cross-block," "cross-blocked," and "cross-blocking" are used interchangeably herein to mean the ability of an Avimer to interfere with the binding of antibodies to sclerostin. The extent to which an Avimer is able to interfere with the binding of another to sclerostin, and therefore whether it can be said to cross-block, can be determined using competition binding assays. In some aspects of the invention, a cross-blocking Avimer reduces sclerostin binding of a reference antibody between about 40% and about 100%, such as about 60% and about 100%, specifically between 70% and 100%, and more specifically between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to sclerostin.

DKK1

In some embodiments, the Avimer described herein comprises a DKK1 binding portion. In certain embodiments, the sclerostin Avimer is fused to a DKK1 antibody. A "DKK1 antibody" binds to DKK1 or portions thereof to block or impair binding of human DKK1 to one or more ligands. Human DKK1 polynucleotide and amino acid sequences are found in U.S. Pat. No. 8,101,184, incorporated herein in its entirety. Examples of DKK1 antibodies suitable for use in the context of the invention are described in International Publication No. WO 2012/118903, the disclosure of which is incorporated herein by reference. In some embodiments, the DKK1 antibody cross-blocks or competes with the binding of at least one of Antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4 (all of which are described in International Publication No. WO 2012/118903) to DKK1. Alternatively, or in addition, the DKK1 antibody is cross-blocked from binding to DKK1 by at least one of antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4. The terms "cross-block," "cross-blocked," and "cross-blocking" are used interchangeably herein to mean the ability of an antibody to interfere with the binding of other antibodies to DKK1. The extent to which an antibody is able to interfere with the binding of another to DKK1, and therefore whether it can be said to cross-block, can be determined using competition binding assays. In some aspects, a cross-blocking Avimer reduces DKK1 binding of a reference antibody between about 40% and about 100%, such as about 60% and about 100%, or between 70% and 100%, or between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to DKK1.

In some embodiments, the DKK1 antibody cross-blocks the binding of an immunoglobulin comprising full length heavy and light chains to DKK1 and/or is cross-blocked from binding to DKK1 by an immunoglobulin comprising full length heavy and light chains, wherein the immunoglobulin comprising full length heavy and light chains.

Examples of suitable DKK1 antibodies and fragments thereof include antibodies and antibody fragments having one or more of CDR-H1, CDR-H2, CDR-H3, CDR-L1, CDR-L2 and CDR-L3 specifically disclosed herein and disclosed in International Publication No. WO 2012/118903, which is incorporated herein by reference in its entirety. In some embodiments, at least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Exemplary DKK1 antibodies include, but are not limited to, Antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4 (all of which are described in International Publication No. WO 2012/118903).

The CDR sequences of some of the DKK1 binding components that are provided may also differ such that the amino acid sequence for any given sequence differs by no more than 1, 2, 3, 4 or 5 amino acid residues. Differences from the listed sequences are typically, but not limited to, conservative substitutions.

In other embodiments, the portion of the Avimer that binds to DKK1 is selected from those DKK1 binding molecules disclosed in U.S. Pat. No. 7,709,611, U.S. Patent Publ. No. 2008/0193449, U.S. Pat. Nos. 7,642,238, 7,700,101, and WO 2007/084344, the disclosure of all of which are incorporated herein by reference in their entireties.

In additional embodiments, it is contemplated that one of skill in the art could also fuse an Avimer that binds sclerostin to a DKK1 antibody or an Avimer that binds DKK1 to a sclerostin antibody. DKK1 antibodies and sclerostin antibodies are well known in the art (sclerostin antibodies are described in U.S. Patent Publication No. 20070110747; DKK1 antibodies are described in International Publication No. WO 2012/118903, each of which are incorporated herein in their entirety). The Avimer can be N-terminal or C-terminal to the antibody. It is also contemplated that an Avimer-antibody fusion is bispecific in nature such that can bind and neutralize (1) Sclerostin or (2) Dkk-1 or (3) both Sclerostin and Dkk-1 simultaneously.

Polynucleotides Encoding Engineered Heavy or Light Chains

Encompassed within the invention are nucleic acids encoding heavy and/or light chain constant and/or variable domains described herein. Nucleic acid molecules of the invention include DNA and RNA in both single-stranded and double-stranded form, as well as the corresponding complementary sequences. DNA includes, for example, cDNA, genomic DNA, chemically synthesized DNA, DNA amplified by PCR, and combinations thereof. The nucleic acid molecules of the invention include full-length genes or cDNA molecules as well as a combination of fragments thereof. The nucleic acids of the invention are preferentially derived from human sources, but the invention includes those derived from non-human species, as well.

An "isolated nucleic acid" is a nucleic acid that has been separated from adjacent genetic sequences present in the genome of the organism from which the nucleic acid was isolated, in the case of nucleic acids isolated from naturally-occurring sources. In the case of nucleic acids synthesized enzymatically from a template or chemically, such as PCR products, cDNA molecules, or oligonucleotides for example, it is understood that the nucleic acids resulting from such processes are isolated nucleic acids. An isolated nucleic acid molecule refers to a nucleic acid molecule in the form of a separate fragment or as a component of a larger nucleic acid construct. In one preferred embodiment, the nucleic acids are substantially free from contaminating endogenous material. The nucleic acid molecule has preferably been derived from DNA or RNA isolated at least once in substantially pure form and in a quantity or concentration enabling identification, manipulation, and recovery of its component nucleotide sequences by standard biochemical methods (such as those outlined in Sambrook et al., Molecular Cloning: A Laboratory Manual, 2nd ed., Cold Spring Harbor Laboratory, Cold Spring Harbor, N.Y. (1989)). Such sequences are preferably provided and/or constructed in the form of an open reading frame uninterrupted by internal non-translated sequences, or introns, that are typically present in eukaryotic genes. Sequences of non-translated DNA can be present 5' or 3' from an open reading frame, where the same do not interfere with manipulation or expression of the coding region.

The present invention also includes nucleic acids that hybridize under moderately stringent conditions, and more preferably highly stringent conditions, to nucleic acids encoding polypeptides as described herein. The basic parameters affecting the choice of hybridization conditions and guidance for devising suitable conditions are set forth by Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. One way of achieving moderately stringent conditions involves the use of a prewashing solution containing 5×SSC, 0.5% SDS, 1.0 mM EDTA (pH 8.0), hybridization buffer of about 50% formamide, 6×SSC, and a hybridization temperature of about 55 degrees C. (or other similar hybridization solutions, such as one containing about 50% formamide, with a hybridization temperature of about 42 degrees C.), and washing conditions of about 60 degrees C., in 0.5×SSC, 0.1% SDS. Generally, highly stringent conditions are defined as hybridization conditions as above, but with washing at approximately 68 degrees C., 0.2×SSC, 0.1% SDS. SSPE (1×SSPE is 0.15M NaCl, 10 mM NaH.sub.2 PO.sub.4, and 1.25 mM EDTA, pH 7.4) can be substituted for SSC (1×SSC is 0.15M NaCl and 15 mM sodium citrate) in the hybridization and wash buffers; washes are performed for 15 minutes after hybridization is complete. It should be understood that the wash temperature and wash salt concentration can be adjusted as necessary to achieve a desired degree of stringency by applying the basic principles that govern hybridization reactions and duplex stability, as known to those skilled in the art and described further below (see, e.g., Sambrook et al., 1989). When hybridizing a nucleic acid to a target nucleic acid of unknown sequence, the hybrid length is assumed to be that of the hybridizing nucleic acid. When nucleic acids of known sequence are hybridized, the hybrid length can be determined by aligning the sequences of the nucleic acids and identifying the region or regions of optimal sequence complementarity. The hybridization temperature for hybrids anticipated to be less than 50 base pairs in length should be 5 to 10.degrees C. less than the melting temperature (Tm) of the hybrid, where Tm is determined according to the following equations. For hybrids less than 18 base pairs in length, Tm (degrees C.)=2(# of A+T bases)+4(# of #G+C bases). For hybrids above 18 base pairs in length, Tm (degrees C.)=81.5+16.6(log 10 [Na+])+0.41(% G+C)−(600/N), where N is the number of bases in the hybrid, and [Na+] is the concentration of sodium ions in the hybridization buffer ([Na+] for 1×SSC=0.165M). Preferably, each such hybridizing nucleic acid has a length that is at least 15 nucleotides (or more preferably at least 18 nucleotides, or at least 20 nucleotides, or at least 25 nucleotides, or at least 30 nucleotides, or at least 40 nucleotides, or most preferably at least 50 nucleotides), or at least 25% (more preferably at least 50%, or at least 60%, or at least 70%, and most preferably at least 80%) of the length of the nucleic acid of the present invention to which it hybridizes, and has at least 60% sequence identity (more preferably at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, and most preferably at least 99.5%) with the nucleic acid of the present invention to which it hybridizes, where sequence identity is determined by comparing the sequences of the hybridizing nucleic acids when aligned so as to maximize overlap and identity while minimizing sequence gaps as described in more detail above.

Variants are ordinarily prepared by site specific mutagenesis of nucleotides in the DNA encoding the polypeptide, using cassette or PCR mutagenesis or other techniques well known in the art, to produce DNA encoding the variant, and thereafter expressing the recombinant DNA in cell culture as outlined herein. However, antibodies or antibody fragments comprising variant CDRs having up to about 100-150 residues may be prepared by in vitro synthesis using established techniques. The variants typically exhibit the same qualitative biological activity as the naturally occurring analogue, e.g., binding to antigen, although variants can also be selected which have modified characteristics as will be more fully outlined herein.

As will be appreciated by those in the art, due to the degeneracy of the genetic code, an extremely large number of nucleic acids may be made, all of which encode the CDRs (and heavy and light chains or other components of a polypeptide described herein) of the invention. Thus, having identified a particular amino acid sequence, those skilled in the art could make any number of different nucleic acids, by simply modifying the sequence of one or more codons in a way which does not change the amino acid sequence of the encoded protein.

The invention also provides expression systems and constructs in the form of plasmids, expression vectors, transcription or expression cassettes which comprise at least one polynucleotide as above. In addition, the invention provides host cells comprising such expression systems or constructs.

Typically, expression vectors used in the host cells will contain sequences for plasmid maintenance and for cloning and expression of exogenous nucleotide sequences. Such sequences, collectively referred to as "flanking sequences," in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the polypeptide coding sequence; the oligonucleotide sequence encodes polyHis (such as hexaHis), or another "tag" such as FLAG, HA (hemaglutinin influenza virus), or myc, for which commercially available antibodies exist. This tag is typically fused to the polypeptide upon expression of the polypeptide, and can serve as a means for affinity purification or detection of the polypeptide from the host cell. Affinity purification can be accomplished, for example, by column chromatography using antibodies against the tag as an affinity matrix. Optionally, the tag can subsequently be removed from the purified polypeptide by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors of this invention may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antibody light or heavy chain. As a result, increased quantities of a polypeptide are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed. In certain embodiments, one or more coding regions may be operably linked to an internal ribosome binding site (IRES), allowing translation of two open reading frames from a single RNA transcript.

In some cases, such as where glycosylation is desired in a eukaryotic host cell expression system, one may manipulate the various pre- or prosequences to improve glycosylation or yield. For example, one may alter the peptidase cleavage site of a particular signal peptide, or add prosequences, which also may affect glycosylation. The final protein product may have, in the −1 position (relative to the first amino acid of the mature protein) one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors of the invention will typically contain a promoter that is recognized by the host organism and operably linked to the molecule encoding the polypeptide. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe gene to which they are operably linked, that is, with little or no control over gene expression. A large number of promoters, recognized by a variety of potential host cells, are well known. A suitable promoter is operably linked to the DNA encoding e.g., heavy chain or light chain, by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus and most preferably Simian Virus 40 (SV40). Other suitable mammalian promoters include heterologous mammalian promoters, for example, heat-shock promoters and the actin promoter.

Additional promoters which may be of interest include, but are not limited to: SV40 early promoter (Benoist and Chambon, 1981, Nature 290:304-310); CMV promoter (Thornsen et al., 1984, Proc. Natl. Acad. U.S.A. 81:659-663); the promoter contained in the 3' long terminal repeat of Rous sarcoma virus (Yamamoto et al., 1980, Cell 22:787-797); herpes thymidine kinase promoter (Wagner et al., 1981, Proc. Natl. Acad. Sci. U.S.A. 78:1444-1445); promoter and regulatory sequences from the metallothionine gene Prinster et al., 1982, Nature 296:39-42); and prokaryotic promoters such as the beta-lactamase promoter (Villa-Kamaroff et al., 1978, Proc. Natl. Acad. Sci. U.S.A. 75:3727-3731); or the tac promoter (DeBoer et al., 1983, Proc. Natl. Acad. Sci. U.S.A. 80:21-25). Also of interest are the following animal transcriptional control regions, which exhibit tissue specificity and have been utilized in transgenic animals: the elastase I gene control region that is active in pancreatic acinar cells (Swift et al., 1984, Cell 38:639-646; Omitz et al., 1986, Cold Spring Harbor Symp. Quant. Biol. 50:399-409; MacDonald, 1987, Hepatology 7:425-515); the insulin gene control region that is active in pancreatic beta cells (Hanahan, 1985, Nature 315:115-122); the immunoglobulin gene control region that is active in lymphoid cells (Grosschedl et al., 1984, Cell 38:647-658; Adames et al., 1985, Nature 318:533-538; Alexander et al., 1987, Mol. Cell. Biol. 7:1436-1444); the mouse mammary tumor virus control region that is active in testicular, breast, lymphoid and mast cells (Leder et al., 1986, Cell 45:485-495); the albumin gene control region that is active in liver (Pinkert et al., 1987, Genes and Devel. 1:268-276); the alpha-feto-protein gene control region that is active in liver (Krumlauf et al., 1985, Mol. Cell. Biol. 5:1639-1648; Hammer et al., 1987, Science 253:53-58); the alpha 1-antitrypsin gene control region that is active in liver (Kelsey et al., 1987, Genes and Devel. 1:161-171); the beta-globin gene control region that is active in myeloid cells (Mogram et al., 1985, Nature 315:338-340; Kollias et al., 1986, Cell 46:89-94); the myelin basic protein gene control region that is active in oligodendrocyte cells in the brain (Readhead et al., 1987, Cell 48:703-712); the myosin light chain-2 gene control region that is active in skeletal muscle (Sani, 1985, Nature 314:283-286); and the gonadotropic releasing hormone gene control region that is active in the hypothalamus (Mason et al., 1986, Science 234:1372-1378).

An enhancer sequence may be inserted into the vector to increase transcription of DNA encoding light chain or heavy chain of the invention by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The vector may contain one or more elements that facilitate expression when the vector is integrated into the host cell genome. Examples include an EASE element (Aldrich et al. 2003 Biotechnol Prog. 19:1433-38) and a matrix attachment region (MAR). MARs mediate structural organization of the chromatin and may insulate the integrated vactor from "position" effect. Thus, MARs are particularly useful when the vector is used to create stable transfectants. A number of natural and synthetic MAR-containing nucleic acids are known in the art, e.g., U.S. Pat. Nos. 6,239,328; 7,326,567; 6,177,612; 6,388,066; 6,245,974; 7,259,010; 6,037,525; 7,422,874; 7,129,062.

Expression vectors of the invention may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain sequence has been inserted into the proper site of the vector, the completed vector may be inserted into a suitable host cell for amplification and/or polypeptide expression. The transformation of an expression vector into a selected host cell may be accomplished by well known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes polypeptide that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule. A host cell may be eukaryotic or prokaryotic.

Mammalian cell lines available as hosts for expression are well known in the art and include, but are not limited to, immortalized cell lines available from the American Type Culture Collection (ATCC) and any cell lines used in an expression system known in the art can be used to make the recombinant polypeptides of the invention. In general, host cells are transformed with a recombinant expression vector that comprises DNA encoding a desired polypeptide. Among the host cells that may be employed are prokaryotes, yeast or higher eukaryotic cells. Prokaryotes include gram negative or gram positive organisms, for example E. coli or bacilli. Higher eukaryotic cells include insect cells and established cell lines of mammalian origin. Examples of suitable mammalian host cell lines include the COS-7 line of monkey kidney cells (ATCC CRL 1651) (Gluzman et al., 1981, Cell 23:175), L cells, 293 cells, C127 cells, 3T3 cells (ATCC CCL 163), Chinese hamster ovary (CHO) cells, or their derivatives such as Veggie CHO and related cell lines which grow in serum-free media (Rasmussen et al., 1998, Cytotechnology 28: 31), HeLa cells, BHK (ATCC CRL 10) cell lines, and the CVI/EBNA cell line derived from the African green monkey kidney cell line CVI (ATCC CCL 70) as described by McMahan et al., 1991, EMBO J. 10: 2821, human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Optionally, mammalian cell lines such as HepG2/3B, KB, NIH 3T3 or S49, for example, can be used for expression of the polypeptide when it is desirable to use the polypeptide in various signal transduction or reporter assays. Alternatively, it is possible to produce the polypeptide in lower eukaryotes such as yeast or in prokaryotes such as bacteria. Suitable yeasts include *Saccharomyces cerevisiae, Schizosaccharomyces pombe, Kluyveromyces* strains, *Candida*, or any yeast strain capable of expressing heterologous polypeptides. Suitable bacterial strains include *Escherichia coli, Bacillus subtilis, Salmonella typhimurium*, or any bacterial strain capable of expressing heterologous polypeptides.

If the antibody or fragment is made in yeast or bacteria, it may be desirable to modify the product produced therein, for example by phosphorylation or glycosylation of the appropriate sites, in order to obtain a functional product. Such covalent attachments can be accomplished using known chemical or enzymatic methods. A polypeptide can also be produced by operably linking the isolated nucleic acid of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A. (the MaxBac kit), and such methods are well known in the art, as described in Summers and Smith, Texas Agricultural Experiment Station Bulletin No. 1555 (1987), and Luckow and Summers, Bio/Technology 6:47 (1988). Cell-free translation systems could also be employed to produce polypeptides, such as antibodies or fragments, using RNAs derived from nucleic acid constructs disclosed herein. Appropriate cloning and expression vectors for use with bacterial, fungal, yeast, and mammalian cellular hosts are described by Pouwels et al. (Cloning Vectors: A Laboratory Manual, Elsevier, New York, 1985). A host cell that comprises an isolated nucleic acid of the invention, preferably operably linked to at least one expression control sequence, is a "recombinant host cell".

In certain embodiments, cell lines may be selected through determining which cell lines have high expression levels and constitutively produce antigen binding proteins with the desired binding properties. In another embodiment, a cell line from the B cell lineage that does not make its own antibody but has a capacity to make and secrete a heterologous antibody can be selected.

Therapeutic Methods

The polypeptide molecules described herein are useful for treating or preventing bone-related disorders, such as bone-related disorders associated with abnormal osteoblast or osteoclast activity. In some embodiments, the polypeptide is administered to a subject suffering from a bone related disorder selected from the group consisting of achondroplasia, cleidocranial dysostosis, enchondromatosis, fibrous dysplasia, Gaucher's Disease, hypophosphatemic rickets, Marfan's syndrome, multiple hereditary exotoses, neurofibromatosis, osteogenesis imperfecta, osteopetrosis, osteopoikilosis, sclerotic lesions, pseudoarthrosis, pyogenic osteomyelitis, periodontal disease, anti-epileptic drug induced bone loss, primary and secondary hyperparathyroidism, familial hyperparathyroidism syndromes, weightlessness induced bone loss, osteoporosis in men, postmenopausal bone loss, osteoarthritis, renal osteodystrophy, infiltrative disorders of bone, oral bone loss, osteonecrosis of the jaw, juvenile Paget's disease, melorheostosis, metabolic bone diseases, mastocytosis, sickle cell anemia/disease, organ transplant related bone loss, kidney transplant related bone loss, systemic lupus erythematosus, ankylosing spondylitis, epilepsy, juvenile arthritides, thalassemia, mucopolysaccharidoses, Fabry Disease, Turner Syndrome, Down Syndrome, Klinefelter Syndrome, leprosy, Perthe's Disease, adolescent idiopathic scoliosis, infantile onset multi-system inflammatory disease, Winchester Syndrome, Menkes Disease, Wilson's Disease, ischemic bone disease (such as Legg-Calve-Perthes disease and regional migratory osteoporosis), anemic states, conditions caused by steroids, glucocorticoid-induced bone loss, heparin-induced bone loss, bone marrow disorders, scurvy, malnutrition, calcium deficiency, osteoporosis, osteopenia, alcoholism, chronic liver disease, postmenopausal state, chronic inflammatory conditions, rheumatoid arthritis, inflammatory bowel disease, ulcerative colitis, inflammatory colitis, Crohn's disease, oligomenorrhea, amenorrhea, pregnancy-related bone loss, diabetes mellitus, hyperthyroidism, thyroid disorders, parathyroid disorders, Cushing's disease, acromegaly, hypogonadism, immobilization or disuse, reflex sympathetic dystrophy syndrome, regional osteoporosis, osteomalacia, bone loss associated with joint replacement, HIV associated bone loss, bone loss associated with loss of growth hormone, bone loss associated with cystic fibrosis, chemotherapy-associated bone loss, tumor-induced bone loss, cancer-related bone loss, hormone ablative bone loss, multiple myeloma, drug-induced bone loss, anorexia nervosa, disease-associated facial bone loss, disease-associated cranial bone loss, disease-associated bone loss of the jaw, disease-associated bone loss of the skull, bone loss associated with aging, facial bone loss associated with aging, cranial bone loss associated with aging, jaw bone loss associated with aging, skull bone loss associated with aging, and bone loss associated with space travel.

In some embodiments, the Avimer-antibody fusions described herein are useful for improving outcomes in orthopedic procedures, dental procedures, implant surgery, joint replacement, bone grafting, bone cosmetic surgery and bone repair such as fracture healing, nonunion healing, delayed union healing and facial reconstruction. A composition comprising one or more Avimer-antibody fusions or fragments may be administered before, during and/or after the procedure, replacement, graft, surgery or repair.

The polypeptide need not cure the subject of the disorder or completely protect against the onset of a bone-related disorder to achieve a beneficial biological response. The polypeptide may be used prophylactically, meaning to protect, in whole or in part, against a bone-related disorder or symptom thereof. The polypeptide also may be used therapeutically to ameliorate, in whole or in part, a bone-related disorder or symptom thereof, or to protect, in whole or in part, against further progression of a bone-related disorder or symptom thereof. Indeed, the materials and methods of the invention are particularly useful for increasing bone mineral density and maintaining the increased bone mineral density over a period of time.

In some embodiments, one or more administrations of a polypeptide described herein are carried out over a therapeutic period of, for example, about 1 week to about 18 months (e.g., about 1 month to about 12 months, about 1 month to about 9 months or about 1 month to about 6 months or about 1 month to about 3 months). In some embodiments, a subject is administered one or more doses of a polypeptide described herein over a therapeutic period of, for example about 1 month to about 12 months (52 weeks) (e.g., about 2 months, about 3 months, about 4 months, about 5 months, about 6 months, about 7 months, about 8 months, about 9 months, about 10 months, or about 11 months). In some embodiments, a subject is administered one or more doses of the polypeptide to maintain bone mineral density. The term "maintain bone mineral density" as used herein means that the increased bone mineral density resulting from the initial dose of the polypeptide does not fall more than about 1% to about 5% over the course of about 6 months, about 9 months about 1 year, about 18 months, about 2 years, or over the course of the patient's life). It will be appreciated that a patient can require alternate treatment phases for increasing bone density and maintaining bone density.

In addition, it may be advantageous to administer multiple doses of the polypeptide or space out the administration of doses, depending on the therapeutic regimen selected for a particular subject. In some embodiments, the polypeptide is administered periodically over a time period of one year (12 months, 52 weeks) or less (e.g., 9 months or less, 6 months or less, or 3 months or less). In this regard, the polypeptide is administered to the human once every about 3 days, or about 7 days, or 2 weeks, or 3 weeks, or 4 weeks, or 5 weeks, or 6 weeks, or 7 weeks, or 8 weeks, or 9 weeks, or 10 weeks, or 11 weeks, or 12 weeks, or 13 weeks, or 14 weeks, or 15 weeks, or 16 weeks, or 17 weeks, or 18 weeks, or 19 weeks, or 20 weeks, or 21 weeks, or 22 weeks, or 23 weeks, or 6 months, or 12 months.

In some embodiments, one or more doses of the polypeptide are administered in an amount and for a time effective to treat a bone disorder associated with decreased bone mineral density. In various embodiments, one or more doses comprising from about 50 milligrams to about 1,000 milligrams of the polypeptide are administered per week to a subject (e.g., a human subject). For example, a dose of polypeptide can comprise at least about 5 mg, 15 mg, 25 mg, 50 mg, about 60 mg, about 70 mg, about 80 mg, about 90 mg, about 100 mg, about 120 mg, about 150 mg, about 200 mg, about 240 mg, about 250 mg, about 280 mg, about 300 mg, about 350 mg, about 400 mg, about 420 mg, about 450 mg, about 500 mg, about 550 mg, about 600 mg, about 650 mg, about 700 mg, about 750 mg, about 800 mg, about 850 mg, about 900 mg, about 950 mg or up to about 1,000 mg of polypeptide. Ranges between any and all of these endpoints are also contemplated, e.g. about 50 mg to about 80 mg, about 70 mg to about 140 mg, about 70 mg to about 270 mg, about 75 mg to about 100 mg, about 100 mg to about 150 mg, about 140 mg to about 210 mg, or about 150 mg to about 200 mg, or about 180 mg to about 270 mg, or about 280 to about 410 mg. The dose is administered at any interval, such as multiple times a week (e.g., twice or three times per week), once a week, once every two weeks, once every three weeks, or once every four weeks. In some or any embodiments, a dose of polypeptide ranging from about 120 mg to about 210 mg is administered twice a week. In some or any embodiments, a dose of about 140 mg of the polypeptide is administered twice a week.

In some embodiments, the one or more doses of polypeptide can comprise between about 0.1 to about 50 milligrams (e.g., between about 5 and about 50 milligrams), or about 1 to about 100 milligrams, of polypeptide per kilogram of body weight (mg/kg). For example, the dose of polypeptide may comprise at least about 0.1 mg/kg, 0.5 mg/kg, 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 20 mg/kg, about 25 mg/kg, about 26 mg/kg, about 27 mg/kg, about 28 mg/kg, about 29 mg/kg, about 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, or about 49 mg/kg, or about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, or up to about 100 mg/kg. Ranges between any and all of these endpoints are also contemplated, e.g., about 1 mg/kg to about 3 mg/kg, about 1 mg/kg to about 5 mg/kg, about 1 mg/kg to about 8 mg/kb, about 3 mg/kg to about 8 mg·kg, about 1 mg/kg to about 10 mg/kg, about 1 mg/kg to about 20 mg/kg, about 1 mg/kg to about 40 mg/kg, about 5 mg/kg to about 30 mg/kg, or about 5 mg/kg to about 20 mg/kg.

Monitoring Therapy

Polypeptide-mediated increases in bone mineral content or bone density may be measured using single- and dual-energy X-ray absorptiometry, ultrasound, computed tomography, radiography, and magnetic resonance imaging. The amount of bone mass may also be calculated from body weights or by using other methods (see Guinness-Hey, Metab. Bone Dis. Relat. Res., 5:177-181 (1984)). Animal models are used in the art for testing the effect of the pharmaceutical compositions and methods on, for example, parameters of bone loss, bone resorption, bone formation, bone strength, or bone mineralization that mimic conditions of human disease such as osteoporosis and osteopenia. Examples of such models include the ovariectomized rat model (Kalu, Bone and Mineral, 15:175-192 (1991); Frost and Jee, Bone and Mineral, 18:227-236 (1992); and Jee and Yao, J. Musculoskel. Neuron. Interact., 1:193-207 (2001)). The methods for measuring polypeptide activity described herein also may be used to determine the efficacy of other sclerostin inhibitors.

In humans, bone mineral density can be determined clinically using dual x-ray absorptiometry (DXA) of, for example, the hip and spine. Other techniques include quantitative computed tomography (QCT), ultrasonography, single-energy x-ray absorptiometry (SXA), and radiographic absorptiometry. Common central skeletal sites for measurement include the spine and hip; peripheral sites include the forearm, finger, wrist and heel. Except for ultrasonography, the American Medical Association notes that BMD techniques typically involve the use of x-rays and are based on the principle that attenuation of the radiation depends on thickness and composition of the tissues in the radiation path. All techniques involve the comparison of results to a normative database.

Alternatively, a physiological response to one or more sclerostin binding agents can be gauged by monitoring bone marker levels. Bone markers are products created during the bone remodeling process and are released by bone, osteoblasts, and/or osteoclasts. Fluctuations in bone resorption and/or bone formation "marker" levels imply changes in bone remodeling/modeling. The International Osteoporosis Foundation (IOF) recommends using bone markers to monitor bone density therapies (see, e.g., Delmas et al., Osteoporos Int., Suppl. 6:S2-17 (2000), incorporated herein by reference). Markers indicative of bone resorption (or osteoclast activity) include, for example, C-telopeptide (e.g., C-terminal telopeptide of type 1 collagen (CTX) or serum cross-linked C-telopeptide), N-telopeptide (N-terminal telopeptide of type 1 collagen (NTX)), deoxypyridinoline (DPD), pyridinoline, urinary hydroxyproline, galactosyl hydroxylysine, and tartrate-resistant acid phosphatase (e.g., serum tartrate-resistant acid phosphatase isoform 5b). Bone formation/mineralization markers include, but are not limited to, bone-specific alkaline phosphatase (BSAP), peptides released from N- and C-terminal extension of type I procollagen (P1NP, PICP), and osteocalcin (OstCa). Several kits are commercially-available to detect and quantify markers in clinical samples, such as urine and blood.

Combination Therapy

Treatment of a pathology by combining two or more agents that target the same pathogen or biochemical pathway or biological process sometimes results in greater efficacy and diminished side effects relative to the use of a therapeutically relevant dose of each agent alone. In some cases, the efficacy of the drug combination is additive (the efficacy of the combination is approximately equal to the sum of the effects of each drug alone), but in other cases the effect is synergistic (the efficacy of the combination is greater than the sum of the effects of each drug given alone). As used herein, the term "combination therapy" means that two or more agents are delivered in a simultaneous manner, e.g., concurrently, or wherein one of the agents is administered first, followed by the second agent, e.g., sequentially.

In some embodiments, the polypeptide is administered along with a standard of care therapeutic for the treatment of decreased bone mineral density (i.e., the polypeptide and standard of care therapeutic are part of the same treatment plan). As used herein, the term "standard of care" refers to a treatment that is generally accepted by clinicians for a certain type of patient diagnosed with a type of illness. In some embodiments, the polypeptide is administered along with a second bone-enhancing agent useful for the treatment of decreased bone mineral density or bone defect. In some embodiments, the bone-enhancing agent is selected from the group consisting of an anti-resorptive agent, a bone-forming agent (i.e., anabolic), an estrogen receptor modulator (including, but not limited to, raloxifene, bazedoxifene and lasofoxifene) and a drug that has an inhibitory effect on osteoclasts. In some embodiments, the second bone-enhancing agent is selected from the group consisting of a bisphosphonate (including, but not limited to, alendronate sodium (FOSAMAX®), risedronate, ibandronate sodium (BONIVA®) and zoledronic acid (RECLAST®)); an estrogen or estrogen analogue; an anti-RANK ligand (RANKL) inhibitor, such as an anti-RANKL antibody (e.g., PROLIA®); vitamin D, or a vitamin D derivative or mimic thereof; a calcium source, a cathepsin-K (cat-K) inhibitor (e.g. odanacatib), Tibolone, calcitonin or a calcitriol; and hormone replacement therapy. In some embodiments, the second bone-enhancing agent includes, but is not limited to, parathyroid hormone (PTH) or a peptide fragment thereof, PTH-related protein (PTHrp), bone morphogenetic protein, osteogenin, NaF, a PGE2 agonist, a statin, strontium ranelate, a sclerostin inhibitor (e.g., an sclerostin antibody described in, for example, U.S. Pat. Nos. 7,592,429 or 7,872,106), and an DKK1 antibody or inhibitor. In some embodiments, the second bone-enhancing agent is Forteo® (Teriparatide), Preotact®, or Protelos®.

In some embodiments, the combination therapy employing a polypeptide described herein may precede or follow administration of additional therapeutic(s) (e.g., second bone-enhancing agent) by intervals ranging from minutes to weeks to months. For example, separate modalities are administered within about 24 hours of each other, e.g., within about 6-12 hours of each other, or within about 1-2 hours of each other, or within about 10-30 minutes of each other. In some situations, it may be desirable to extend the time period for treatment significantly, where several days (2, 3, 4, 5, 6 or 7 days) to several weeks (1, 2, 3, 4, 5, 6, 7 or 8 weeks) lapse between the respective administrations of different modalities. Repeated treatments with one or both agents/therapies of the combination therapy is specifically contemplated.

Maintenance Therapeutic Regimen

Also contemplated is the use of a second bone-enhancing agent and/or polypeptide described herein in a maintenance regimen to, e.g., prevent or slow the loss of bone mineral density. In this regard, a method or use described herein optionally comprises administering one or more amounts of a second bone-enhancing agent effective to maintain bone mineral density for a maintenance period of about 1 week to about 5 years after the treatment period with the polypeptide has ended. For example, in some embodiments, a method or use described herein comprises the administration of a second bone-enhancing agent to the subject for a maintenance period of about at least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 25 weeks, 26 weeks, 27 weeks 28 weeks, 7 months, 29 weeks, 30 weeks, 31 weeks or longer (e.g., 8 months, 9 months, 10 months, 11 months, 1 year, 15 months, 18 months, 2 years, 3 years, 4 years, 5 years or longer (e.g., over the lifetime of the subject). In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 years, about 3 years, about 4 years, about 5 years or longer. "Maintaining" bone mineral density includes maintaining similar levels of bone mineral density parameters experienced in the subject that received the polypeptide treatment.

Similarly, a method or use described herein optionally comprises subsequently administering one or more amounts of a polypeptide effective to maintain bone mineral density for a maintenance period of at least about least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 1 year, 2 years, 3 years, 4 years, 5 years or longer (e.g., over the lifetime of the subject) after the treatment period has ended. In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 year, about 3 year, about 4 years, about 5 years or longer.

Pharmaceutical Compositions

In some embodiments, the invention provides a pharmaceutical composition comprising a therapeutically effective amount of one or a plurality of the antigen binding proteins of the invention together with a pharmaceutically effective diluents, carrier, solubilizer, emulsifier, preservative, and/or adjuvant. Pharmaceutical compositions of the invention include, but are not limited to, liquid, frozen, and lyophilized compositions.

Preferably, formulation materials are nontoxic to recipients at the dosages and concentrations employed. In specific embodiments, pharmaceutical compositions comprising a therapeutically effective amount of polypeptide are provided.

In some embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine, proline, or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

In some embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the polypeptide. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and may further include sorbitol or a suitable substitute therefor. In certain embodiments of the invention, the composition may be prepared for storage by mixing the selected composition having the desired degree of purity with optional formulation agents (REMINGTON'S PHARMACEUTICAL SCIENCES, supra) in the form of a lyophilized cake or an aqueous solution. Further, in some embodiments, the polypeptide may be formulated as a lyophilizate using appropriate excipients such as sucrose.

The pharmaceutical compositions of the invention can be selected for parenteral delivery. Alternatively, the compositions may be selected for inhalation or for delivery through the digestive tract, such as orally. Preparation of such pharmaceutically acceptable compositions is within the skill of the art. The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions for use in this invention may be provided in the form of a pyrogen-free, parenterally acceptable aqueous solution comprising the desired polypeptide in a pharmaceutically acceptable vehicle. A particularly suitable vehicle for parenteral injection is sterile distilled water in which the polypeptide is formulated as a sterile, isotonic solution, properly preserved. In certain embodiments, the preparation involves the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired polypeptide.

Pharmaceutical compositions of the invention can be formulated for inhalation. In these embodiments, polypeptide is advantageously formulated as a dry, inhalable powder. In specific embodiments, polypeptide inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins.

It is also contemplated that formulations can be administered orally. Polypeptides that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized. Additional agents can be included to facilitate absorption of the polypeptide. Diluents, flavorings, low melting point waxes, vegetable oils, lubricants, suspending agents, tablet disintegrating agents, and binders may also be employed.

Additional pharmaceutical compositions will be evident to those skilled in the art, including formulations involving antigen binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP058481, each of which is incorporated by reference), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP133988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP036676; EP088046 and EP143949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Aspects of the invention includes self-buffering polypeptide formulations, which can be used as pharmaceutical compositions, as described in international patent application WO 2006/138181A2 (PCT/US2006/022599), which is incorporated by reference in its entirety herein.

As discussed above, certain embodiments provide polypeptide compositions, particularly pharmaceutical polypeptide compositions, that comprise, in addition to the polypeptide, one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution," in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions," Pharm Biotechnol. 13: 159-75 (2002), each of which is herein incorporated by reference in its entirety, particularly in parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention.

As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in polypeptide formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations.

Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the polypeptide formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product.

Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188.

Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of polypeptide formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins.

Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by Al+3 ions.

Embodiments of the polypeptide formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol.

Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

Polypeptide formulations generally will be designed for specific routes and methods of administration, for specific administration dosages and frequencies of administration, for specific treatments of specific diseases, with ranges of bio-availability and persistence, among other things. Formulations thus may be designed in accordance with the invention for delivery by any suitable route, including but not limited to orally, aurally, opthalmically, rectally, and vaginally, and by parenteral routes, including intravenous and intraarterial injection, intramuscular injection, and subcutaneous injection.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. The invention also provides kits for producing a single-dose administration unit. The kits of the invention may each contain both a first container having a dried protein and a second container having an aqueous formulation. In certain embodiments of this invention, kits containing single and multi-chambered pre-filled syringes (e.g., liquid syringes and lyosyringes) are provided.

The therapeutically effective amount of an antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication(s) for which the antigen binding protein is being used, the route of administration, and the size (body weight, body surface or organ size) and/or condition (the age and general health) of the patient. In certain embodiments, the clinicians may titer the dosage and modify the route of administration to obtain the optimal therapeutic effect.

Stability

The terms "stability" and "stable" as used herein in the context of a composition comprising a polypeptide (or antigen binding fragment thereof) refer to the resistance of the polypeptide (or antigen binding fragment thereof) in the composition to aggregation, degradation or fragmentation under given manufacture, preparation, transportation and/or storage conditions. Antibody formulations comprising a high degree of stability demonstrate enhanced reliability and safety and, as such, are advantageous for clinical use.

Antibody stability in a composition is optionally assessed by examining a desired parameter of the antibody in the composition (e.g., aggregation, degradation of heavy and/or light chains, chemical modification, etc.) over time. In this regard, a parameter is typically examined at an initial time point T0) and an assessment time point (T1), optionally while exposing the Avimer to any of a number of environmental conditions, and compared. An initial time point can be, for instance, the time that the Avimer is first formulated in a composition or first examined for quality (i.e., examined to determine whether the antibody composition meets regulatory or manufacturing specifications with respect to aggregation or degradation). An initial time point also can be the time at which the antibody or antibody fragment is reformulated in a composition (e.g., reformulated at a higher or lower concentration compared to an initial preparation). An assessment time point is, in various embodiments, about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year) after the initial time point. The desired parameter (e.g., aggregation or degradation) of the Avimer in the composition can be assessed under a variety of storage conditions, such as temperatures of −30° C., 4° C., 20° C. or 40° C., shaking, pH, storage in different container materials (e.g., glass vials, pre-filled syringes, etc.), and the like.

Exemplary methods for determining the degree of aggregation, and/or types and/or sizes of aggregates present in a composition comprising the polypeptide include, but are not limited to, size exclusion chromatography (SEC), high performance size exclusion chromatography (HPSEC), static light scattering (SLS), Fourier Transform Infrared Spectroscopy (FTIR), circular dichroism (CD), urea-induced protein unfolding techniques, intrinsic tryptophan fluorescence, differential scanning calorimetry, and 1-anilino-8-naphthalenesulfonic acid (ANS) protein binding techniques. Size exclusion chromatography (SEC) may be performed to separate molecules on the basis of their size, by passing the molecules over a column packed with the appropriate resin, the larger molecules (e.g. aggregates) will elute before smaller molecules (e.g. monomers). The molecules are generally detected by UV absorbance at 280 nm and may be collected for further characterization. High pressure liquid chromatographic columns are often utilized for SEC analysis (HP-SEC). Alternatively, analytical ultracentrifugation (AUC) may be utilized. AUC is an orthogonal technique which determines the sedimentation coefficients (reported in Svedberg. S) of macromolecules in a liquid sample. Like SEC, AUC is capable of separating and detecting antibody fragments/aggregates from monomers and is further able to provide information on molecular mass. Antibody or antibody fragment aggregation in a composition may also be characterized by particle counter analysis using a coulter counter or by turbidity measurements using a turbidimeter. Turbidity is a measure of the amount by which the particles in a solution scatter light and, thus, may be used as a general indicator of protein aggregation. In addition, non-reducing polyacrylamide gel electrophoresis (PAGE) or capillary gel electrophoresis (CGE) may be used to characterize the aggregation and/or fragmentation state of antibodies or antibody fragments in a composition.

Exemplary methods for determining antibody degradation include, but are not limited to, size-exclusion chromatography (SEC), sodium dodecyl sulfate-polyacrylamide gel electrophoresis (SDS-PAGE) and capillary electrophoresis with SDS (CE-SDS) and reversed phase HPLC with in-line MS detection.

In various embodiments, less than 5% of the polypeptide or antibody fragment described herein in the composition is in aggregate form under conditions of interest. For instance, less than 4%, or less than 3%, or less than 2%, or less than 1% of the polypeptide in the composition is in aggregate form after storage at −30° C., 4° C., 20° C. or 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some embodiments, less than 5% (or less than 4% or less than 3% or less than 2% or less than 1% or less) of the polypeptide of antibody fragment described herein in the composition is in aggregate form after storage for two weeks at about 4° C.

For example at least 85% (or at least 90%, or at least 91%, or at least 92%, or at least 93%, or at least 94%, or at least 95%, or at least 96%, or at least 97%, or at least 98%, or at least 99%) of Avimer in a composition optionally is present in non-aggregate (i.e., monomeric) form after storage at −30° C., 4° C., 20° C. or 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some embodiments, at least 85% (or at least 90%, or at least 91%, or at least 92%, or at least 93%, or at least 94%, or at least 95%, or at least 96%, or at least 97%, or at least 98%, or at least 99% or more) of the Avimer is present in the composition in non-aggregate form after two weeks of storage at about 4° C. In some embodiments, at least 99% of the antibody is present in the composition in non-aggregate form after storage for two weeks at about 4° C. for two weeks and/or at least 95% of antibody present is in the compositions is in non-aggregate form after storage for two weeks at 40° C.

In various embodiments, less than 5% of the Avimer described herein in the composition is degraded. For instance, less than 4%, or less than 3%, or less than 2%, or less than 1% or less of the polypeptide in the composition is degraded under conditions of interest. For example, optionally at least 85% (or at least 90%, or at least 91%, or at least 92%, or at least 93%, or at least 94%, or at least 95%, or at least 96%, or at least 97%, or at least 98%, or at least 99%) of the antibody or fragment is intact (i.e., not degraded) in a composition stored at about −30° C., about 4° C., about 20° C. or about 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some aspects, at least 85% (or at least 90%, or at least 91%, or at least 92%, or at least 93%, or at least 94%, or at least 95%, or at least 96%, or at least 97%, or at least 98%, or at least 99% or more) of the Avimer is intact (i.e., non-degraded) after storage in a composition at about 4° C. for a period of two weeks. In some embodiments, at least 99% of the antibody or fragment remains intact when stored in a composition at about 4° C. for two weeks and/or at least 95% remains intact when stored in a composition at about 40° C. for two weeks.

Functional or activity stability of the polypeptide (or antigen binding fragment there) in a composition also is contemplated herein. Assays for detecting and/or quantifying, e.g., antibody binding to a target, sclerostin neutralization, and DKK-1 neutralization are known in the art and are described herein in Examples 4-6. Optionally, the Avimer demonstrates about 50-100% activity under conditions of interest compared to the activity of the Avimer at the initial time point. For example, the Avimer retains a level of activity of between about 60-90% or 70-80% compared to the activity the initial time point. Accordingly, functional stability of the Avimer includes retention of activity of at least about 50%, 55%, 60%, 65%, 70%, 75%, 80%, 85%, 90%, 95% or 100% and can include activity measurements greater than 100% such as 105%, 110%, 115%, 120%, 125% or 150% or more compared to the activity at the initial time point.

Viscosity

In some embodiments, the viscosity of a composition comprising one or more of the Avimer-antibody fusions described herein is determined. The term "viscosity" as used herein refers to "absolute viscosity." Absolute viscosity, sometimes called dynamic or simple viscosity, is the product of kinematic viscosity and fluid density (Absolute Viscosity=Kinematic Viscosity×Density). The dimension of kinematic viscosity is $L^2/T$ where L is a length and T is a time. Commonly, kinematic viscosity is expressed in centistokes (cSt). The SI unit of kinematic viscosity is $mm^2/s$, which is 1 cSt. Absolute viscosity is expressed in units of centipoise (cP). The SI unit of absolute viscosity is the millipascal-second (mPa-s), where 1 cP=1 mPa-s.

The viscosity of a composition can be measured hours (e.g., 1-23 hours), days (e.g., 1-10 days), weeks (e.g., 1-5 weeks), months (e.g., 1-12 months), or years (e.g., 1-2 years, 1-3 years) after the addition of the antibody to the composition. Viscosity measurements may be made at a storage or administration temperature, e.g. 2-8° C. or 25° C. (room temperature). In some embodiments, absolute viscosity of the liquid or reconstituted liquid composition at the storage and/or administration temperature is 15 cP or less, or 14, 13, 12, 11, 10, 9, 8, 7, 6, 5, or 4 cP or less. In some embodiments, absolute viscosity of the liquid or reconstituted liquid composition is 6 cP or less.

In some embodiments, the viscosity of the antibody composition is measured prior to and after the addition of polypeptide. Methods of measuring viscosity are well known in the art and include, for example, using a capillary viscometer, or a cone-plate rheometer. Any method may be used provided the same method is used to compare the test and reference formulations.

Kits

A pharmaceutical composition comprising one or more heterodimeric antibodies described herein may be placed within containers (e.g., vials or syringes), along with packaging material that provides instructions regarding the use of such pharmaceutical compositions. Generally, such instructions will include a tangible expression describing the polypeptide concentration, as well as within certain embodiments, relative amounts of excipient ingredients or diluents (e.g., water, saline or PBS) that may be necessary to reconstitute the pharmaceutical composition.

EXAMPLES

Example 1

Generation of Peptides

Methods—FM2 Avimers

Avimer DNA Library synthesis, Phage display panning, Avimer protein expression, purification and screening have been previously described (Nat. Biotech. 2005:23, 1156-61).

AlphaScreen: Sclerostin/LRP-6 Inhibition Assay for His-Tagged Avimers

To measure inhibition of either Sclerostin or Dkk-1 binding to LRP-6, dose response curves were generated by first serially diluting (1:3-dilutions for 12-pts) Avimers in assay buffer (40 mM sodium HEPES pH 7.5, 100 mM NaCl, 1 mM CaCl2, 0.1% BSA, 0.05% Tween-20), last point containing buffer only. Next, 2 uL of the above mentioned Avimer dilution was transferred from dilution plate into a 384-well, reduced volume, white, Greiner microtiter assay plate. Next, 2 uL of biotin labeled (human or rat) recombinant Sclerostin (2 nM) or (human or rat) recombinant Dkk-1 (0.5 nM) was added to the microtiter plate, followed by the addition of 2 uL of recombinant huLRP-6/Fc (3 nM for Sclerostin or 0.3 nM for Dkk-1) and AlphaScreen 'donor' streptavidin and 'acceptor' protein A beads (10 µg/ml each) (Perkin Elmer). All dilutions were made in the above buffer. The microtiter plate was then sealed and incubated overnight at 20° C. Inhibition was measured as a decrease in chemiluminescent signal as measured on the EnVision (Perkin Elmer) using excitation at 680 nm and emission at 520-620 nm.

AlphaScreen Sclerostin/LRP-6 Inhibition Assay for Untagged Avimer-Ab Fusions

To measure inhibition of either Sclerostin or Dkk-1 binding to LRP-6, dose response curves were generated by first serially diluting (1:3 dilutions for 12-pts) Avimer-Ab Fusions in assay buffer (40 mM sodium HEPES pH 7.5, 100 mM NaCl, 1 mM CaCl2, 0.1% BSA, 0.05% Tween-20), last point containing buffer only. Next, 2 uL of the above mentioned Avimer dilution was transferred from dilution plate into a 384-well, reduced volume, white, Greiner microtiter assay plate. Next, 2 uL of biotin labeled (human or rat) recombinant Sclerostin (2 nM) or (human or rat) recombinant Dkk-1 (0.5 nM) was added to the microtiter plate, followed by the addition of 2 uL of recombinant muLRP-6/His (3 nM for Sclerostin or 0.3 nM for Dkk-1) and AlphaScreen 'donor' streptavidin and 'acceptor' Nickel Chelate beads (10 µg/ml each) (Perkin Elmer). All dilutions were made in the above buffer. The microtiter plate was then sealed and incubated overnight at 20° C. Inhibition was measured as a decrease in chemiluminescent signal as measured on the EnVision (Perkin Elmer) using excitation at 680 nm and emission at 520-620 nm.

Yeast Display Selection of FM2 Avimers

Hemagglutinin-tagged Avimer walked dimer genes from Round 3 phage pools were amplified by PCR and subcloned into a yeast display vector, fusing them to the alpha agglutinin C-terminal domain for yeast cell surface anchorage. Yeast pools contained 1E07-1E08 transformants. Three additional rounds of selection (rounds 4-6) were performed on the yeast pools using fluorescence-assisted cell sorting. Yeast pools were incubated with biotinylated human or rat sclerostin in TBS+2 mM CaCl2+1 mg/mL BSA, and stained with an AlexaFluor488-anti-HA antibody (for display) and streptavidin-phycoerthythrin (PE) conjugate (for sclerostin binding) prior to sorting. Cells within an Alexa488/PE double-positive population were collected (top 0.2-0.5%) and grown to saturation. At least a tenfold excess of cells relative to the number recovered from sorting were removed and induced to display before entering the next round of selection. Increased stringency was applied by lowering the concentration of sclerostin from 10 nM in Round 4 to 100 pM in Round 6. De-selection against human Wise binding was performed in rounds 5 and 6 by additionally incubating the yeast cells with 100 nM human Wise and a strepatvidin-allophycocyanin (APC) conjugate following binding of sclerostin and streptavidin-PE. Cells within the Alexa488-positive/PE-positive/APC-negative population were collected.

Osteoblast Wnt1 Reporter Assay

The engineered bispecific antibodies were capable of neutralizing Dkk1 and Sclerostin which are inhibitors of Wnt1 induced TCF/LEF luciferase activity as determined in an osteblast cell based assay. The osteoblast MC3T3E1/TetON-Wnt1/STF-Luc#5 cell line was engineered by lentiviral transduction with a T-Cell Factor (TCF)-responsive luciferase construct, a Tet repressor construct and a doxycycline inducible Wnt1 construct. In this assay, addition of doxycycline (10 ng/ml) to the culture medium for 22-26 hr induced expression of Wnt1 and signal transduction via the binding of Wnt1 to cell surface LRP5/6 and Frizzled receptors, resulting in the expression of the luciferase reporter gene. MC3T3E1/TetON-Wnt1/STF-luc#5 cells were incubated in the presence of Sclerostin and/or Dkk1 and Wnt signaling was inhibited due to competitive binding of Sclerostin and Dkk1 to LRP5/6. Human Dkk1 protein (0.1 ug/ml) or human Sclerostin protein (1 g/ml) were premixed with control PBS or a serial dilution of the bispecific antibodies. 24 hrs later the luciferase signal was determined as described above and the data were plotted by using PRISM software. As summarized in Figure X, the bispecific antibodies dose-dependently inhibited Sclerostin and Dkk1 and restored Wnt signaling induced by Wnt1.

Pharmacokinetic Studies in Rats.

Each test article was injected either intravenously or sub-cutaneously to two Sprague Dawley rats at 2.5 or 5.0 mg/kg dosing. 12 Blood samples were taken from each rat covering times from pre-dose to 672 hours post-dose. Blood was processed to serum and analyzed with conventional PK ELISAs for both total molecules (that retain the Fc scaffold) as well as intact molecules (that retain target binding). Phamacokinetic profiles were analyzed and typical PK parameters such as half life, and $AUC_{0\text{-}inf}$ were estimated.

The pharmacokinetic profiles of the DKK1 antibody-anti-SOST Avimer fusion constructs were determined in adult Sprague-Dawley rats (n=2 per group) by injecting 5 mg/kg subcutaneously and collecting approximately 250 μL of blood in Microtainer® serum separator tubes at 0, 0.5, 2, 4, 8, 24, 48, 96, 168, 336, 504, 672, 840 and 1008 hours post-dose from the lateral tail vein. Each sample was maintained at room temperature following collection, and following a 30-40 minute clotting period, samples were centrifuged at 2-8° C. at 11,500 rpm for about 10 minutes using a calibrated Eppendorf 5417R Centrifuge System (Brinkmann Instruments, Inc., Westbury, N.Y.). The collected serum was then transferred into a pre-labeled (for each rat), cryogenic storage tube and stored at −60° C. to −80° C. for future analysis. To measure the serum sample concentrations from the PK study samples, the following two Total (Fc/Fc) and Intact (SOST/Fc) methods were used. The Total assay was performed as follow: ½ area black plate (Corning 3694) was coated with 2 μg/ml of anti-hu Fc, antibody 1.35.1 in PBS and then incubated overnight at 4° C. The plate was then washed and blocked with I-Block™ (Applied Biosystems) overnight at 4° C. If samples needed to be diluted, then they were diluted in Rat SD serum. The standards and samples were then diluted 1:20 in 1×PBS+1M NaCl+0.5% Tween 20 and 1% BSA buffer (5% serum). The plate was washed and 50-μl samples of diluted standards and samples were transferred into an antibody 1.35.1 coated plate and incubated for 1.5 h at room temperature. The plate was washed, then 50 μl of 100 ng/ml of anti-hu Fc antibody 21.1-HRP conjugate in I-Block™+5% BSA was added and incubated for 1.5 h. The plate was washed, then 50 IA of Pico substrate were added, after which the plate was immediately analyzed with a luminometer. The Intact assay was performed as follow: ½ area black plate (Corning 3694) was coated with 1 μg/ml of hu Sclerostin in PBS and then incubated overnight at 4° C. The plate was then washed and blocked with I-Block™ (Applied Biosystems) overnight at 4° C. If samples needed to be diluted, then they were diluted in Rat SD serum. The standards and samples were then diluted 1:20 in 1×PBS+1M NaCl+0.5% Tween 20 buffer (5% serum). The plate was washed and 50-μl samples of diluted standards and samples were transferred into a Sclerostin coated plate and incubated for 1.5 h at room temperature. The plate was washed, then 50 μl of 100 ng/ml of anti-hu Fc antibody 1.35.1-HRP conjugate in I-Block™+5% BSA was added and incubated for 1.5 h. The plate was washed, then 50 μl of Pico substrate were added, after which the plate was immediately analyzed with a luminometer.

Time concentration data were analyzed using non-compartmental methods with WinNonLin® (Enterprise version 5.1.1, 2006, Pharsight® Corp. Mountain View, Calif.).

In Vivo BMD Measurement in Young Mice

The ability of bispecific antibody-Avimer fusions to increase bone mass was determined by administering the bispecific molecule subcutaneously into male B6D2F1 mice (Harlan). Ten-week-old male mice were injected with vehicle control, or the rat bispecific antibodies (Bispec-Ab), or neutralizing antibodies against either rat sclerostin or rat Dkk1. The antibodies were dosed twice per week for a period of three weeks. The bispecific antibody-Avimer fusions and control antibodies were administered at equimolar doses (dose of X mg/kg and 25 mg/kg respectively due to the smaller molecular weight of the bispecific antibody). Study groups were balanced by bone mineral density at the initiation of the study. BMD was measured at baseline by Piximus and once per week for three weeks. The sites measured by Piximus were the lumbar vertebrae (L1-L5) and the femur and tibia. Significant increases in BMD were noted at both sites for the bispecific antibody-Avimer fusions as early as one week after treatment and the response continued to increase and further differentiate itself from vehicle over the treatment period. The data shown in Figure X represent the percent change in baseline at the femur and tibia at the end of the study (3-weeks). All treatments resulted in significantly increased BMD compared to the vehicle treated group. Therefore, these data indicate that the bispecific antibody-Avimer fusions have inhibitory activity towards both Sclerostin and Dkk1 and may have therapeutic benefit in conditions of bone loss and repair.

Figure 1B:
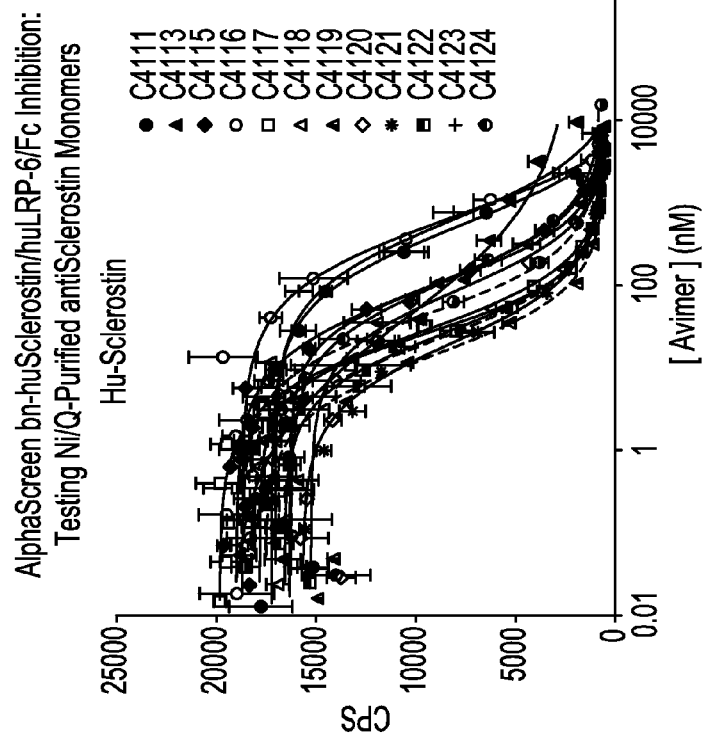

Sclerostin Neutralizing Avimer Monomers; Sclerostin Neutralizing Affinity Matured Monomers Naive Avimer libraries were panned against human and rat Sclerostin targets to select individual Avimer domains that preferentially bound to these targets. Screening was performed with AlphaScreen to then identify single clones that additionally blocked the Sclerostin/LRP6 interaction. A total of 48 naïve Avimer domains were identified to neutralize both human and rat Sclerostin in AlphaScreen assays with in vitro IC50 potencies as good as 20 to 40 nM (Table 1 and FIG. 1).

Figure 2D:
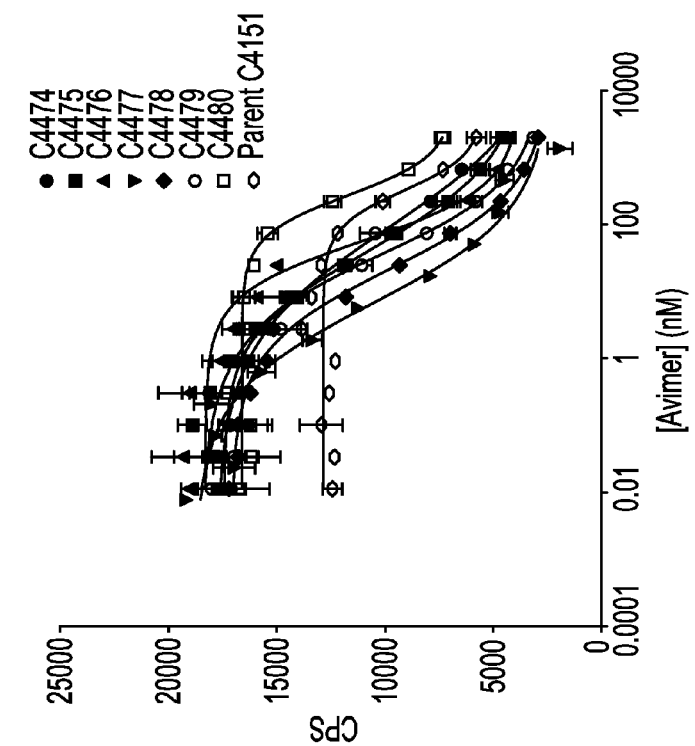
FIG. 2: Representative affinity matured Avimer monomers neutralize Sclerostin in AlphaScreen assays.
Figure 2C:
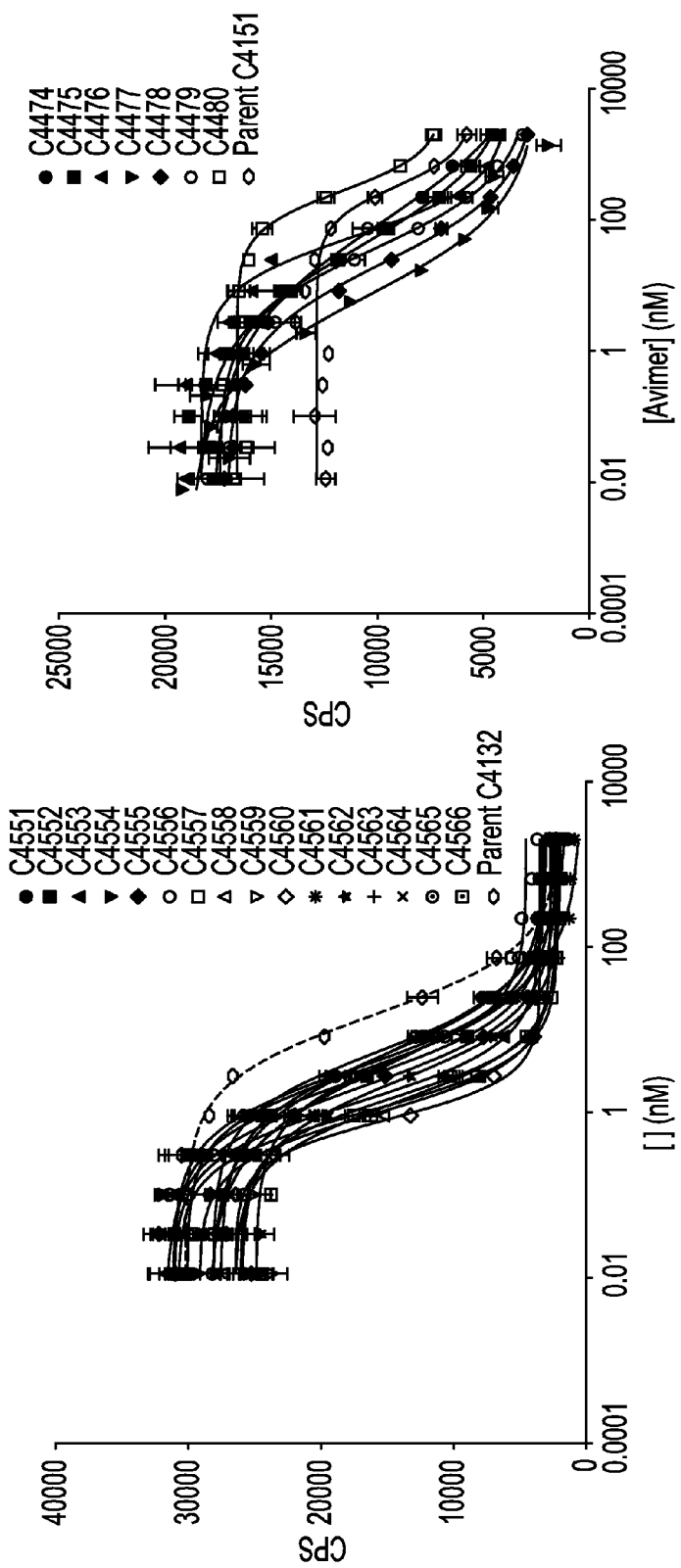

In order to improve the neutralization activity Avimer monomers, six top clones were affinity matured (C4113, C4132, C4150, C4151, C4402 and C4426). From six campaigns, a total of 98 different affinity matured Avimers were identified that neutralize Sclerostin (Table 2). In vitro AlphaScreen inhibition potencies in cases were over 10-fold improvement over the parental Avimer clones (FIG. 2) and several were as good as ~1 nM IC50.

TABLE 1

Sclerostin neutralizing naive Avimer monomer amino acid sequences

| Avimer | Avimer amino acid sequence |
|---|---|
| C4111 | CAPNEFQCRGYNICIPQEWVCDGEDDCEDDSDETDCGDSHILPFSTPGPST |
| C4113 | CEPGQFQCHSYNKCVPPTWVCDGVLDCVDSSDEANCSQDPEFHKV |
| C4115 | CGSREFPCRGTDICLPPAWRCDGEDDCVDNSDETDCAPHT |
| C4116 | CGSSEFPCHGSDICIPQHWVCDGEDDCWDSSDEKSCEERT |
| C4117 | CGSSEFPCHGSDICISAHWRCDGDDDCGDDSDESSDNCGDSHILPFSTPGPST |
| C4118 | CGSSEFPCHGSDICISEEWGCDGVDDCEDSSDETSCSAPASEPPGSL |
| C4119 | CGSSEFPCHGTDICLPQRWLCDGVDDCGDDSDEENCEGTERT |
| C4120 | CGSSEFPCKGNDICLPPPWLCDGDNDCQDDSDETGCGDSHILPFSTPGPST |
| C4121 | CGSSEFPCQGSDICLPPPWLCDGDDDCEDGSDEPLANCAATEHT |
| C4122 | CGSSEFPCQGSDICLPPPWLCDGDDDCEDGSDETDCAPHT |
| C4123 | CGSSEFPCQGTDICIPQDWVCDGDDDCLDSSDEASCSQDPEFHKV |
| C4124 | CGSSEFPCQGTDICIPQTWLCDGDDDCEDSSDETNCGRPGPGATSAPAA |
| C4126 | CGSSEFPCQGTDICIPQTWLCDGDDDCQDGSDETDCAPHT |
| C4127 | CGSSEFPCQGTDICIPQTWLCDGDDDCQDGSDETSCSAPASEPPGSL |
| C4128 | CGSSEFPCQGTDICIPQTWLCDGDNDCVDNSDETGCGDSHILPFSTPGPST |
| C4129 | CGSSEFPCQGTDICIPQTWLCDGVDDCLDDSDEANCGDSHILPFSTPGPST |
| C4131 | CGSSEFPCQGTDICLPQHWLCDGEDDCGDDSDEPPAHCEEPT |
| C4132 | CGSSEFPCQGTDICLSPAWRCDGDDDCLDNSDEANCSQDPEFHKV |
| C4133 | CGSSEFPCQGTDICLSPAWRCDGDDDCLDNSDEASCKAPVHT |
| C4134 | CGSSEFPCQGTDICLSPAWRCDGDDDCLDNSDEENCSQDPEFHKV |
| C4135 | CGSSEFPCRGNDICLPQRWLCDGENDCPDDSDETNCSAPASEPPGSL |
| C4137 | CGSSEFPCRGSDICLPQTWRCDGDNDCVDNSDETGCGDSHILPFSTPGPST |
| C4138 | CGSSEFPCRGTDICIPATWVCDGDNDCVDSSDEANCSAPASEPPGSL |
| C4140 | CGSSEFPCRGTDICISERWVCDGENDCLDDSDEEGCGDSHILPFSTPGPST |
| C4141 | CGSSQFPCRGTDICLSERWVCDGENDCLDDSDEKGCADSHILPFSTPCAST |
| C4142 | CGSSEFPCRGTDICLSWRCDGVPDCEDDSDEALAHCTART |
| C4143 | CGSSEFPCRGTDICLSWRCDGVPDCEDDSDEALDHCSAPASEPPGSL |
| C4144 | CGSSEFPCRGYDICISPAWLCDGDPDCVDDSDEANCGTPEHT |
| C4145 | CGSSEFPCSGTDICIPQGWLCDGDDDCRDDSDEAPELCEQRT |
| C4146 | CGSSEFPCSGYDICLPQQWGCDGVDDCPDDSDEADCGSTVHT |
| C4147 | CGSSQFPCKGTDICLSQRWVCDGEDDCVDGSDEEGCSAPASEPPGSL |
| C4148 | CLSNEFTCRNYNICIPQDWVCDGENDCVDNSDEADCSAPASEPPGSL |
| C4149 | CLSSEFTCRSYDKCVPPAWVCDGVLDCVDGSDETGCSAPASEPPGSL |
| C4150 | CPAFTEFLCKESNRCYPSEWRCDGEMDCADGSDELHCAYHT |

TABLE 1-continued

Sclerostin neutralizing naive Avimer monomer amino acid sequences

| Avimer | Avimer amino acid sequence |
|---|---|
| C4151 | CPAGAFMCRNTTHCVSREMVCDGVPDCPDGSDEIAHCPYRT |
| C4402 | CAPNQFRCNSYDKCVPAHWVCDGVLDCLDSSDETNCSAPASEPPGSL |
| C4408 | CGSSEFPCHGSDICLSGPLVCDGDDDCQDNSDESLDHCAAPEPT |
| C4409 | CGSSEFPCHGTDICLPQRWGCDGVDDCLDGSDEASCKERT |
| C4411 | CGSSEFPCRGSDICLPPRWLCDGEDDCPDGSDESELCRTSVRT |
| C4412 | CGSSEFPCRGTDICIPEEWLCDGDNDCGDGSDEPPLCGRPGPGATSAPAA |
| C4413 | CGSSQFPCQDTDICIPAAWVCDGVIDCLDNSDETNCGDSHILPFSTPGPST |
| C4419 | CVPNEFPCALGGCATSFWTCDGYLDCLDTSDEEACEAPVPT |
| C4420 | CVSSQFQCRGYNKCLPAAWVCDGVIDCLDNSDETNCGDSHILPFSTPGPST |
| C4421 | CVSSQFQCRGYNKCLPAAWVCDGVIDCLDNSDETNCGDSHILPFSTSGPST |
| C4422 | CWANEFHCASGACIPVLWVCDGFIDCLDSSDESFASCSAPASEPPGSL |
| C4423 | CWLEVFKCTAGACSFTMMACDGDLDCWDWSDESLPFCSAPASEPPGSL |
| C4426 | SDVDECVILPGPCELDCVNTFDGYLCHCAPGFGGRLCVGGGGS |
| C4427 | SDVDECVPNPCPLVCVNTPGGFSCFCEPGFLPPDGAPACIGGGGS |
| C4428 | SDVGECILHPGPCELVCVNTPDGYICHCAPGFESPDSTNDCQAVEIS |

TABLE 2

Sclerostin neutralizing Avimer affinity matured monomers amino acid sequence

| Avimer | Avimer amino acid sequence |
|---|---|
| C4459 | CAPGEFQCHSYNKCVPPTWVCDGILDCMDSSDEANCSQDPEFHKV |
| C4457 | CDPGAFQCHSYNKCVPPAWVCDGVLDCLDSSDEANCSQDPEFHKV |
| C4450 | CEMGQFQCHSYNKCVPAIWVCDGILDCLDSSDEANCSQDPEFHKV |
| C4448 | CEPDHFQCHSYLKCVPPTWVCDGVLDCLDSSDEANCSQDPEFHKV |
| C4458 | CEPGEFLCHSYNKCVPPAWVCDGVLDCVDSSDEANCSQDPEFHKV |
| C4439 | CEPGEFQCHSYDKCVPPSWVCDGVLDCLDSSDEANCSQDPEFHKV |
| C4431 | CEPGEFQCHSYNKCVPATWVCDGILDCLDSSDEAYCSQDPEFHKV |
| C4433 | CEPGEFQCHSYNKCVPPTWVCDGVLDCLDSSDEANCSQDPEFHKV |
| C4455 | CEPGEFQCHSYNKCVPTIWVCDGVLDCVDSSDEANCSQDPEFHKV |
| C4432 | CEPGEFQCQSYNKCVPPTWVCDGVLDCLDSSDEANCSQDPEFHKV |
| C4445 | CEPGHFQCHSYNKCVPLIWVCDGVLDCLDSSDEANCSQDPEFHKV |
| C4430 | CEPGHFQCHSYYKCVPPIWVCDGVLDCLDSSDEANCSQDPEFHKV |
| C4456 | CEPGHFQCQSYDKCVPPSWVCDGVLDCLDSSDEANCSQDPEFHKV |
| C4449 | CEPGQFLCHSYNKCVPASWVCDGVLDCMDSSDEVNCSQDPEFHKV |
| C4447 | CEPGQFQCHSYDKCVPPTWVCDGILDCLDSSDEANCSQDPEFHKV |
| C4441 | CEPGQFQCHSYFKCVPPTWVCDGVLDCLDSSDEANCSQDPEFHKV |
| C4446 | CEPGQFQCHSYHKCVPPIWVCDGVLDCLDSSDEANCSQDPEFHKV |

TABLE 2-continued

Sclerostin neutralizing Avimer affinity
matured monomers amino acid sequence

| Avimer | Avimer amino acid sequence |
|---|---|
| C4435 | CEPGQFQCHSYNKCVPPAWICDGVLDCLDSSDEANCSQDPEFHKV |
| C4437 | CEPGQFQCHSYNKCVPPVWVCDGVLDCLDSSDEANCSQDPEFHKV |
| C4434 | CEPGQFQCLTYDKCVPPIWVCDGVLDCMDSSDEANCSQDPEFHKV |
| C4442 | CEPGQFQCYSYNKCVPPTWVCDGVLDCLDSSDEANCSQDPEFHKV |
| C4452 | CEPGWFQCHSYNKCVRSDWVCDGVLDCLDSSDEANCSQDPEFHKV |
| C4436 | CEPGYFQCHSYYKCVPPTWVCDGVLDCLDSSDEANCSQDPEFHKV |
| C4444 | CEPSEFQCQSYDKCVPPIWVCDGVLDCVDSSDEANCSQDPEFHKV |
| C4451 | CEPSQFQCHSYHKCVRPTWVCDGVLDCLDSSDEANCSQDPEFHKV |
| C4438 | CEQGEFECHSYTKCVPPTWVCDGVLDCLDSSDETNCSQDPEFHKV |
| C4443 | CEQGEFQCHSYFKCVPPTWVCDGVLDCLDSSDEANCSQDPEFHKV |
| C4454 | CEQGQFQCHSYYKCVPPIWVCDGVLDCLDSSDEANCSQDPEFHKV |
| C4453 | CEQGYFQCHSYNKCVPPPWVCDGVLDCLDSSDEANCSQDPEFHKV |
| C4440 | CQPPEFQCQSYKKCVPPTWVCDGVLDCVDSSDETNCSQDPEFHKV |
| C4461 | CPAFTEFLCADSNRCYPSEWRCDGEMDCVDGSDEQNCAYHT |
| C4462 | CPAFTEFLCHDSSRCYPSEWRCDGEIDCADSSDELHCAYHT |
| C4463 | CPAFTEFLCKDSNRCYPSEWRCDGEIDCADRSDEQGCAYHT |
| C4464 | CPAFTEFLCKDSNRCYPSEWRCDGEVDCTDGSDELHCAYHT |
| C4465 | CPAFTEFLCKDSQRCYPTEWRCDGEIDCADGSDEHHCAYHT |
| C4466 | CPAFTEFLCQDSNRCYPSEWRCDGEMDCVDASDEHLCAYHT |
| C4467 | CPAFTEFLCRDSNRCYPSEWRCDGEIDCADASDELHCAYHT |
| C4468 | CPAFTEFLCTDSNRCYPSEWRCDGEIDCSDDSDEQDCAYHT |
| C4469 | CPAYTEFLCKDSDRCFPSEWRCDGEMDCVDGSDELHCAYHT |
| C4470 | CPAYTEFLCKDSDRCYPSEWRCDGEMDCADNSDEVHCAYHT |
| C4471 | CHTFADFMCQETYRCHPQGRCDGEMDCSDDSDEVHCAYHT |
| C4472 | CPAYTEFLCKNSNRCFPSEWRCDGEIDCADGSDELHCAYHT |
| C4473 | CPAFTEFLCADSNRCYPSEWRCDGEIDCADASDERHCAYHT |
| C4474 | CPAGAFMCWNDTHCVSREMVCDGVTDCPDGSDEIFHCPYRT |
| C4475 | CPAGAFMCWNTTHCVSREMVCDGITDCPDGSDELFHCPYRT |
| C4476 | CPGGAFMCRNTTHCLGPELVCDGVPDCPDGSDETAHCPYRT |
| C4477 | CPPGAFMCWNATHCVSWEMVCDGVPDCPDGSDEIAYCPYRTSLQKASAAYPYDV<br>PDYAPGLEASGGSCQAGAFICRNTTHCVSRKMVCDGVPDCPDGSDEIAQCPYRT |
| C4478 | CPSGAFMCWNTTHCVSPEMVCDGVDDCPDGSDEIFHCPYRT |
| C4479 | CPTGAFTCWNTTHCVSREMVCDGVDDCPDGSDEIFHCPYRT |
| C4480 | CTAEAFMCRNATPCVSRGKVCDGVPDCPDGSDEIPHCPYRT |
| C4551 | CGSIEFPCEGTDICLSEVWRCDGDDDCLDYSDEANCSQDPEFHKV |
| C4552 | CGSIEFPCMGPDICLSPAWLCDGDDDCLDNSDEAYCSQDPEFHKV |
| C4553 | CGSIEFPCQGTDICLAPEWMCDGDDDCLDNSDEAYCSQDPEFHKV |
| C4554 | CGSLEFPCQGPDICLLPAWQCDGDDDCLDYSDETNCSQDPEFHKV |

TABLE 2-continued

Sclerostin neutralizing Avimer affinity
matured monomers amino acid sequence

| Avimer | Avimer amino acid sequence |
|---|---|
| C4555 | CGSNEFPCQGSDICLAPEWLCDGDDDCLDFSDEAYCSQDPEFHKV |
| C4556 | CGSREFPCLGTDICLLPAWLCDGDDDCLDRSDEVNCSQDPEFHKV |
| C4557 | CGSREFPCQGPDICLLPAWLCDGDDDCLDYSDEEDCSQDPEFHKV |
| C4558 | CGSREFPCQGPDICLLPEWLCDGDDDCLDNSDEAYCSQDPEFHKV |
| C4559 | CGSREFPCQGPDICLSPEWLCDGDDDCMDNSDEDDCSQDPEFHKV |
| C4560 | CGSREFPCQGTDICLPPEWICDGDDNCLDTSDEAYCSQDPEFHKV |
| C4561 | CGSREFPCQGTDICLSPLWRCDGEEDCLDNSDEGNCSQDPEFHKVSLLEASGGSCGSSEFSCHSTDICLSPAWRCDGDDDCLDNSDEANCSQDPEFHKV |
| C4562 | CGSSDFPCWGPDICLSPAWLCDGDDDCLDYSDETDCSQDPEFHKV |
| C4563 | CGSSEFPCHGTDICLAPEWYCDGDDDCLDDSDESYCSQDLEFHKV |
| C4564 | CGSSEFPCQGADICLLPAWSCDGDDDCQDYSDETNCSQDPEFHKV |
| C4565 | CGSSEFPCQGPDICLSPAWLCDGDDDCLDYSDEPDCSQDPEFHKV |
| C4566 | CGSSEFPCQGSDICLAPEWLCDGDDDCLDFSDEAYCSQDPEFHKV |
| C4567 | CGSSEFPCQGTDICLLPAWLCDGDDDCLDESDEAYCSQDPEFHKV |
| C4568 | CGSSEFPCQGTDICLLPEWLCDGDDDCLDDSDESYCSQDPEFHKV |
| C4569 | CGSSEFPCQGTDICLPPAWLCDGDDDCLDNSDEANCSQDPEFHKV |
| C4570 | CGSSEFPCQGTDICLPPSWLCDGDDDCLDTSDEAYCSQDPEFHKV |
| C4571 | CGSYDFPCQGSDICLPPAWSCDGDDDCLDYSDETYCSQDPEFHKV |
| C4572 | CGSYEFPCQGTDICLLPAWLCDGDADCRDYSDETDCSQDPEFHKV |
| C4573 | CGTSEFPCQGTDICLLPAWLCDGDDDCLDDSDEAYCSQDPEFHKV |
| C4574 | CGSREFPCQGTDICLPPAWLCDGDDDCLDNPDEAYCSQDPEFHKV |
| C4771 | CAPNEFRCNSYDKCVPEHWVCDGVLDCLDSSDETNCSAPASEPPGSL |
| C4773 | CAPNQFMCVSYDKCVPAHWVCDGVLDCLDSSDETNCSAPASEPPGSL |
| C4774 | CEPNEFRCNSYDKCVPAHWVCDGVLDCLDSSDETDCSAPASEPPGSL |
| C4775 | CEPNQFLCKSYDKCVPEHWVCDGVLDCLDSSDETNCSAPASEPPGSL |
| C4776 | CGRDHFRCRSYDKCVPAHWLCDGVLDCLDSSDETYCSAPASEPPGSL |
| C4777 | CSADQFKCNSYDKCVPAHWVCDGVLDCLDSSDETNCSAPASEPPGSL |
| C4778 | CSENQFRCISYDKCVPVHWVCDGVLDCLDSSDETNCSAPASEPPGSL |
| C4780 | SDVDECFILPGPCELDCVNTFDGYLCDCAPSFGGRLCVGGGGS |
| C4781 | SDVDECFILPGPCELDCVNTFDGYLCHCAPGFGGRLCVGGGGS |
| C4782 | SDVDECFILPGPCELDCVNTFDGYLCHCAPGFGSRLCVGGGGS |
| C4783 | SDVDECIILPGPCELDCMYTFDGYLCDCAPSFGGRLCVGGGGS |
| C4784 | SDVDECIILPGPCELECVNTFDGYLCHCKPTFGGRLCVGGGGS |
| C4785 | SDVDECVELPGPCELDCVNTFDGYICDCAPSFGGRLCVGGGGS |
| C4786 | SDVDECVILPGPCELDCVDTFDGYLCHCAPSFGGRLCVGGGGS |
| C4787 | SDVDECVILPGPCELDCVNTFDDYVCHCKPSFGGVLCVGGGGS |
| C4788 | SDVDECVILPGPCELDCVNTFDGYLCHCAPSFGGRLCVGGGGS |
| C4789 | SDVDECVILPGPCELDCVNTIDGYICHCAPSFGGRLCVGGGGS |

TABLE 2-continued

Sclerostin neutralizing Avimer affinity matured monomers amino acid sequence

| Avimer | Avimer amino acid sequence |
|---|---|
| C4790 | SDVDECVILPGPCELDCVNTLDDYLCHCAPSFGGQLCVGGGGS |
| C4791 | SDVDECVILPGPCELECVNTFDGYLCDCAPSFGGRLCVGGGGS |
| C4792 | SDVDECVILPGPCELECVNTFDGYLCHCAPSFGGRLCVGGGGS |
| C4793 | SDVDECVILPGPCELECVNTFDGYMCHCAPSFGGRLCVGGGGS |
| C4794 | SDVDECVTLPGPCELDCVNTLDGYLCSCAPSFGGPLCVGGGGS |
| C4853 | SDVDECLILPGPCELDCVNTFDGYLCDCAPSFGGRLCVGGGGS |
| C4854 | SDVDECFILPGPCELDCVDTFDGYLCHCAPSFGGRLCVGGGGS |

Sclerostin Neutralizing Avimer Walked Dimers

In order to improve Sclerostin neutralizing activity of the Avimers, the best Avimer monomers were used as seeds and naïve Avimer libraries were fused to either the N- or C-terminus of these seeds. In this manner, Avimer "walked dimers" were constructed and selected for improved binding and inhibition activities. A total of 58 different Avimer walked dimers were identified that neutralize Sclerostin (Table 3). Representative Alpha Screen inhibition assays show activities typically between 2 and 0.5 nM IC50 (FIG. 3). While these are potent activities and represent new Sclerostin neutralizing Avimer sequences, they are not significantly improved compared to the monomer Avimer seeds.

TABLE 3

Sclerostin neutralizing Avimer walked dimers amino acid sequences

| Avimer | Avimer amino acid sequence |
|---|---|
| C4795 | CPAFTEFLCKDSNRCYPSEWRCDGEVDCTDGSDELHCAYHTCPAGEFQCGNGRCIPQGWLCDGENDCPDNSDEANCTAPART |
| C4797 | CLPGEFQCSSGSCIPQQWLCDGVNDCQDNSDESLDHCGAPVPTCAPNQFRCNSYDKCVPAHWVCDGVLDCLDSSDETNCSAPASEPPGSL |
| C4798 | CEPGEFKCQSSGICIPEAWVCDGVNDCEDNSDEPPEHCPTHTCAPNQFRCNSYDKCVPAHWVCDGVLDCLDSSDETNCSAPASEPPGSL |
| C4799 | CLANEFRCDSGRCISLDWVCDGVNDCEDGSDESLETCEAPGHTCAPNQFRCNSYDKCVPAHWVCDGVLDCLDSSDETNCSAPASEPPGSL |
| C4800 | CLPSEFPCESGHCIPGNWVCDGVNDCEDGSDEPLDHCPAHTCAPNQFRCNSYDKCVPAHWVCDGVLDCLDSSDETNCSAPASEPPGSL |
| C4801 | CLSNEFQCSSGRCIPASWRCDGVNDCGDGSDEAGCGRPGPGATSAPAACPAFTEFLCKDSNRCYPSEWRCDGEVDCTDGSDELHCAYHT |
| C4802 | SDVDECQIDPGPCYSGGTCVNTEDGFNCYCLPGFKGHDCEEPILSCAPNQFRCNSYDKCVPAHWVCDGVLDCLDSSDETNCSAPASEPPGSL |
| C4803 | SDVDECRLPGPCRRGGTCVNAADGFYCDCTPGFDYNYNTNSCEEEVISCAPNQFRCNSYDKCVPAHWVCDGVLDCLDSSDETNCSAPASEPPGSL |
| C4804 | SDVDECVILPGPCELDCVNTFDGYLCHCVPGFNGLNCQGGGGSCAPNQFRCNSYDKCVPAHWVCDGFLDCLDSSDETNCTAPASEPPGSL |
| C4805 | SDVDECRPNPCDHGCVNTASGYSCRCQPGFAPSDDTSDCEIALISCAPNQFRCNSYDKCVPAHWVCDGVLDCLDSSDETNCSAPASEPPGSL |
| C4806 | SDVDECLANPCHPGGTCVNTYSSYQCLCQSGFQSPADTSACEIAIHSCAPNQFRCNSYDKCVPAHWVCDGVLDCLDSSDETNCSAPASEPPGSL |
| C4807 | CPSNQFPCESGQCIPLAWVCDGVNDCQDSSDEEDCGDSHILPFSTPGPSTCGSREFPCQGTDICLPPEWICDGDDDCLETSDEAYCSQDPEFHKV |
| C4808 | CVPGEFTCKNGHCVSLDWLCDGDDDCGDGSDEPPDCETSERTCGSREFPCQGTDICLPPAWLCDGDDDCLDNPDEAYCSQDPEFHKV |
| C4809 | CASSEFQCNNGRCIPANWVCDGVPDCQDGSDEEDCGDSHILPFSTPGPSTCGSREFPCQGTDICLPPEWICDGDDDCLDTPDEAYCSQDPEFHKV |

TABLE 3-continued

Sclerostin neutralizing Avimer walked dimers amino acid sequences

| Avimer | Avimer amino acid sequence |
|---|---|
| C4810 | CRASEFRCRSGRCIPATWLCDGEDDCADGSDEKDCKAPEPTCGSREFPCQGTDICLPPEWICDGDDDCLDTSDEAYCSQDPEFHKV |
| C4811 | CPADEFPCNSGRCIPLAWVCDGENDCGDDSDETSCPTPTCGSREFPCQGTDICLPPEWICDGDDDCLDTPDEAYCSQDPEFHKV |
| C4812 | CAAGQFQCQSYGRCIPPDWVCDGENDCGDDSDEESCETTEPTCGSREFPCQGTDICLPPEWICDGDDDCLDTPDEAYCSQDPEFHKV |
| C4813 | CQSDQFPCGNGHCIPVQWVCDGVNDCGDGSDESEHCTAPAHTCGSREFPCQGTDICLPPEWICDGDDDCLDTSDEAYCSQDPEFHKV |
| C4814 | CLASQFQCGNGHCIPQHWLCDGVDDCVDGSDEADCSQDPEFHKVCGSREFPCQGTDICLPPAWLCDGDDDCLDTPDEAYCSQDPEFHKV |
| C4815 | CPSDQFPCGNGHCIPRRWLCDGVNDCGDGSDEPEQCSQDPEFHKVCGSREFPCQGTDICLPPAWLCDGDDDCLDNPDEAYCSQDPEFHKV |
| C4816 | CPSSEFTCESGKCVPPEWGCDGVDDCGDSSDEPPANCAAPGHTCGSREFPCQGTDICLPPEWICDGDDDCLDTPDEAYCSQDPEFHKV |
| C4817 | CRSSQFQCGSGHCIPETWLCDGENDCRDGSDEPEVCSQDPEFHKVCGSREFPCQGTDICLPPEWICDGDDDCLETSDEAYCSQDPEFHKV |
| C4818 | CPPSQFRCKSGRCIPEHWVCDGENDCGDGSDESQHCGRAAPTCGSREFPCQGTDICLPPAWLCDGDDDCLDNPDEAYCSQDPEFHKV |
| C4819 | CPSGQFTCGSGNCIPRTWLCDGVNDCGDGSDEAPLCKRAVPTCGSREFPCQGTDICLPPAWLCDGDDDCLDTPDEAYCSQDPEFHKV |
| C4820 | CAASQFQCGSGHCVPVGWLCDGVNDCADGSDESALCKAAAPTCGSREFPCQGTDICLPPEWICDGDDDCLDTSDEAYCSQDPEFHKV |
| C4821 | CRSSQFQCGSGQCISGRWVCDGVDDCGDGSDESPLCSAPASEPPGSLCGSREFPCQGTDICLPPAWLCDGDDDCLDTPDEAYCSQDPEFHKV |
| C4822 | CPSSQFQCSSSDICISAPWLCDGVNDCGDNSDEADCSQDPEFHKVCGSREFPCQGTDICLPPAWLCGGDDDCLDNPDEAYCSQDPEFHKV |
| C4823 | CRPNEFTCRSGRCIPPNWVCDGDNDCADDSDEAGCGRPGPGATSAPAACGSREFPCQGTDICLPPEWICDGDDDCLDTPDEAYCSQDPEFHKV |
| C4824 | CGSREFPCQGTDICLPPAWLCDGDDDCLDTPDEAYCSQDPEFHKVCGPNQFQCHSNKTCIPRPWVCDGENDCGDGSDESPHCSQDPEFHKV |
| C4810 | CAPSQFQCGSGQCIPEEWLCDGEPDCPDGSDEPALCTGPEPTCGSREFPCQGTDICLPPEWICDGDDDCLDTSDEAYCSQDPEFHKV |
| C4825 | CQATAEFECRSGRCIPLGWVCDGEDDCGDSSDETGCEGSAPTCPGGAFMCRNTTHCLGPELVCDGVPDCPDGSDETAHCPYRT |
| C4826 | RPPGQFTCSSGNCISAGWLCDGEDDCLDGSDETGCSAPASEPPGSLCEPGQFQCHSYNKCVPPVWVCDGVLDCLDSSDEANCSQDPEFHKV |
| C4827 | CAPDEFKCSNGKCIPPQWGCDGDNDCGDNSDEANCSAPASEPPGSLCQPGQFQCHSYPKCVPPIWVCDGVLDCLDSSDEADCSQDPEFHRV |
| C4828 | CESSEFPCDNGRCLSLHWVCDGEDDCGDGSDEPPECSAPASEPPGSLCEPGHFQCHSYYKCVPPIWVCDGVLDCLDSSDEANCSQDPEFHKV |
| C4829 | CQSSQFQCNSGQCIPPEWLCDGVNDCQDDSDEADCPAPTCQPGQFQCHSYPKCVPPIWVCDGVLDCLDSSDEADCSQDPEFHKV |
| C4830 | CVSGQFTCSNGKCVPQAWLCDGENDCPDGSDESQLCGAPAHTCQPGQFQCHSYPKCVPPIWVCDGVLDCLDSSDEADCSQDPEFHKV |
| C4831 | CASNEFTCENGNCIPGNWLCDGVNDCRDDSDEPLETCATHTCEPGQFQCHSYNKCVPPIWVCDGVLDCLDSSDEANCSQDPEFHKV |
| C4832 | CQSGEFTCGNGSCVPGPLVCDGENDCRDSSDEESCSQDPEFHKVCQPGQFQCHSYPKCVPPIWVCDGVLDCLDSSDEADCSQDPEFHKV |
| C4833 | CESGEFKCNNGSCISAGWLCDGVDDCGDGSDESLENCQTPTCQPGQFQCHSYPKCVPPIWVCDGVLDCLDSSDEADCSQDPEFHKV |

TABLE 3-continued

Sclerostin neutralizing Avimer walked dimers amino acid sequences

| Avimer | Avimer amino acid sequence |
|---|---|
| C4834 | CGASEFTCSSGRCIPLAWLCDGDDDCGDGSDESLATCTAAAPTCPGGAFMCRNTTHCLGPELVCDGVPDCPDGSDETAHCPYRT |
| C4835 | CLSDEFRCRSTGRCIPVTWLCDGVDDCEDSSDEPSDHCQKPTCEPGQFQCHSYNKCVPPVWVCDGVLDCLDSSDEADCSQDPEFHKV |
| C4836 | CEADQFKCGSGSCIPEAWLCDGDNDCGDGSDESAVCPKPTCQPGQFQCHSYPKCVPPIWVCDGVLDCLDSSDEADCSQDPEFHKV |
| C4837 | CLADQFRCDNGHCVPAALVCDGEDDCEDDSDESLAHCEAPAPTCQPGQFQCHSYPKCVPPIWVCDGVLDCLDSSDEADCSQDPEFHKV |
| C4838 | CVPSEFTCESGHCIPLGWLCDGDNDCEDSSDETSCAAPAPTCQPGQFQCHSYPKCVPPIWVCDGILDCLDSSDEADCSQDPEFHKV |
| C4839 | CLSSEFTCSSGQCVSRPWLCDGEDDCADGSDESEECGASVPTCQPGQFQCHSYPKCVPPIWVCDGVLDCLDSSDEADCSQDPEFHKV |
| C4840 | CLPDQFQCKNGSCVPGNWVCDGVNDCGDGSDETGCPKPTCEPGHFQCHSYYKCVPPIWVCDGVLDCLDSSDEADCSQDPEFHKV |
| C4841 | CLSDEFRCGSGKCIPVAWVCDGDNDCGDNSDESLELCRTAGPTCPGGAFMCRNATHCLGPELVCDGVPDCPDGSDETAHCPYRT |
| C4842 | CHSIAEFECRSGHCIPLEWVCDGDNDCADDSDEAGCTGTAPTCPGGAFMCRNTTHCLGPELVCDGVPDCPDGSDETAHCPYRT |
| C4843 | CQPFAEFECGSGNCIPGRWVCDGENDCPDGSDEPEQCSAPASEPPGSLCPGGAFMCRNTTHCLGPELVCDGVPDCPDGSDETAHCPYRT |
| C4844 | CNAFTQFECRSGKCIPAAWVCDGDNDCPDGSDESQHCGDSHILPFSTPGPSTCQPGQFQCHSYPKCVPPIWVCDGVLDCLDSSDEADCSQDPEFHKV |
| C4845 | CVSGQFQCGNGNCVSVPWGCDGVNDCGDSSDEESCRGTVPTCQPGQFQCHSYPKCVPPIWVCDGVLDCLDSSDEADCSQDPEFHKV |
| C4846 | CPANEFTCSNGSCVPEALLCDGEDDCRDNSDEANCGSPGPTCQPGQFQCHSYPKCVPPIWVCDGVLDCLDSSDEADCSQDPEFHKV |
| C4847 | CVADQFQCENGRCISAPWGCDGENDCADSSDETDCPAHTCEPGHFQCHSYPKCVPPIWVCDGVLDCLDSSDEADCSQDPEFHKV |
| C4848 | CLPSEFQCNNGHCISVNWLCDGDNDCGDGSDESAHCTGSTPTCPGGAFMCRNTTHCLGPELVCDGVPDCPDGSDETAHCPYRT |
| C4849 | CQPNQFPCNSGRCIPAGWICDGENDCGDNSDEASCAATVPTCPGGAFMCRNTTHCLGPELVCDGVPDCPDGSDETAHCPYRT |
| C4850 | CEPGQFQCHSYNKCVPPAWICDGVLDCLDSSDEANCSQDPEFHKVCPSGEFQCRGTKICIPPDWVCDGDNDCGDGSDESQHCGDSHILPFSTPGPST |
| C4851 | CQPGQFQCHSYPKCVPPIWVCDGVLDCLDSSDEADCSQDPEFHKVCLPGQFPCKSTGICIPADWVCDGDNDCGDGSDEPEQCATAEPT |
| C4852 | CAPGQFQCHGYETCIPLHWGCDGVNDCEDDSDEEGCPPPTCQPGQFQCHSYPKCVPPIWVCDGVLDCLDSSDEADCSQDPEFHKV |

Rational Dimers

Figure 4B:
FIG. 4: Representative AlphaScreen inhibition activity results for the Sclerostin-neutralizing Avimer rational dimers.
Figure 4A:
Figure 5B:
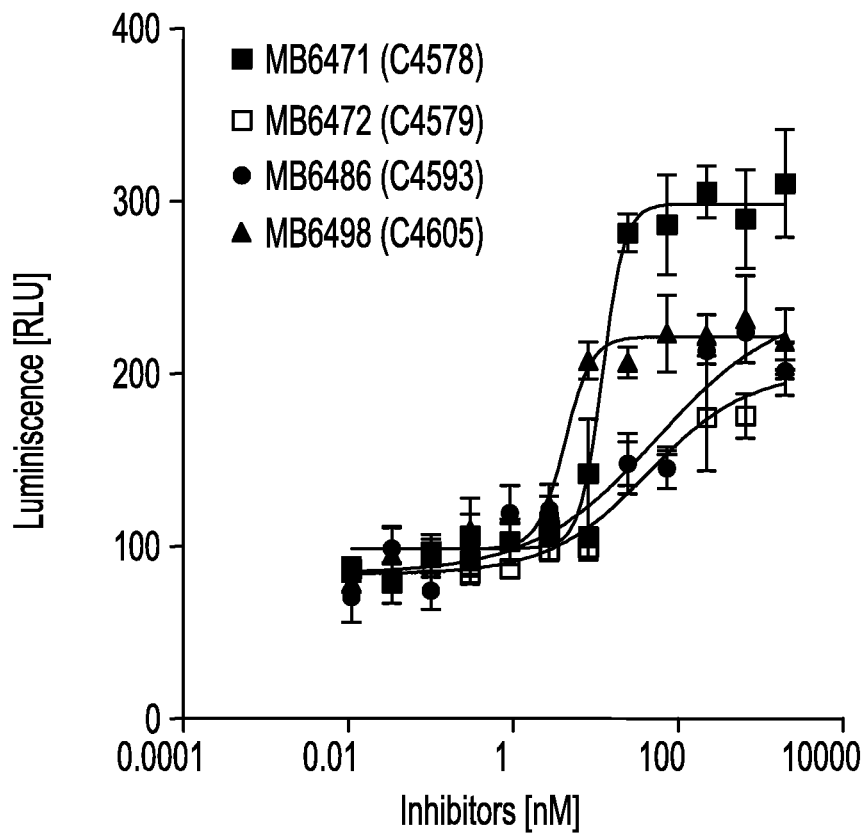
FIG. 5: Representative Wnt1 cell based assay results for the Sclerostin-neutralizing Avimer Rational Dimers.
Figure 6A:
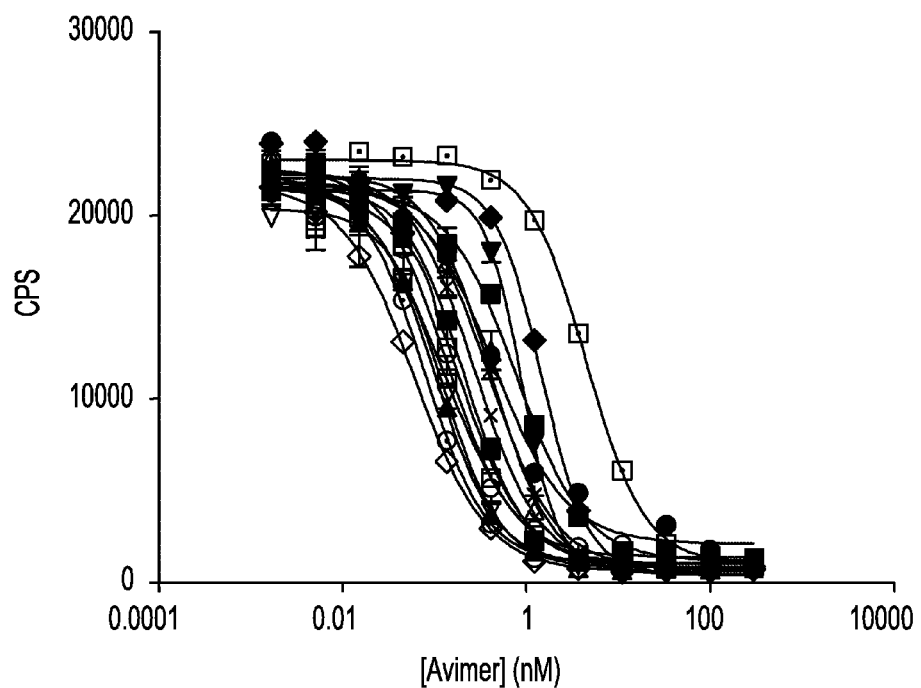
FIG. 6: Avimer Engineered Dimers neutralize Sclerostin with pM 1050 potency in AlphaScreen assay.
Figure 6B:
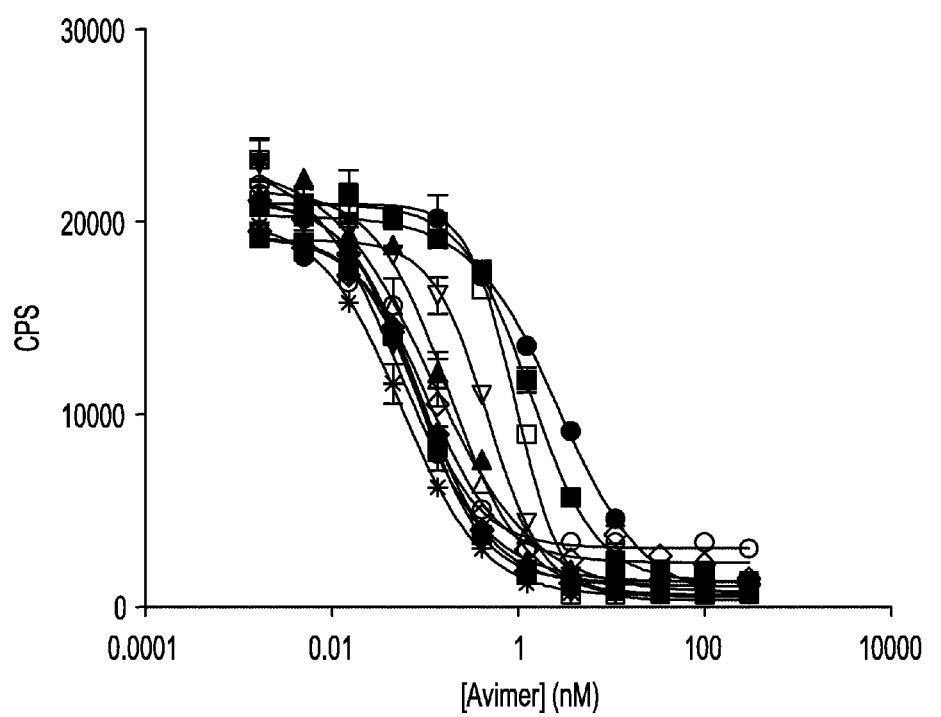

In order to further improve potency of the Sclerostin-neutralizing Avimer monomers, an alternative approach was used where the best domains were fused together in both N- and C-term orientations. The top six Sclerostin-neutralizing Avimer monomers were thereby selected and fused in all possible combinations to form 36 "Rational Dimers" (Table 4). These were tested for the ability to inhibit the Sclerostin/LRP6 interaction with Alpha Screen (FIG. 4), and were found to improve potency up to 10-fold better than the input monomers with several rational dimers having IC50's as low as 120 to 150 pM. The 36 rational dimers were also tested for Sclerostin-neutralizing activity in the Wnt1 cell based assay (FIG. 5) and were also found to have improved potency with IC50's as low as 4 nM, which is close to the limit of sensitivity of the assay.

TABLE 4

Amino Acid sequences of 36 Sclerostin-neutralizing rational dimers.

| | |
|---|---|
| C4575 | CAPNQFRCNSYDKCVPAHWVCDGVLDCLDSSDETNCSAPASEPPGSLCAPNQFRCNSYDKCVPAHWVCDGVLDCLDSSDETNCSAPASEPPGSL |

TABLE 4-continued

Amino Acid sequences of 36 Sclerostin-neutralizing rational dimers.

| | |
|---|---|
| C4576 | SDVDECVILPGPCELDCVNTFDGYLCHCAPGFGGRLCVGGGGSCAPNQFRCNSYDKCVPAHWVCDGVLDCLDSSD ETNCSAPASEPPGSL |
| C4577 | CEPGQFQCHSYNKCVPPAWICDGVLDCLDSSDEANCSQDPEFHKVCAPNQFRCNSYDKCVPAHWVCDGVLDCLDS SDETNCSAPASEPPGSL |
| C4578 | CPAYTEFLCKDSDRCFPSEWRCDGEMDCVDGSDELHCAYHTCAPNQFRCNSYDKCVPAHWVCDGVLDCLDSSDE TNCSAPASEPPGSL |
| C4579 | CPGGAFMCRNTTHCLGPELVCDGVPDCPDGSDETAHCPYRTCAPNQFRCNSYDKCVPAHWVCDGVLDCLDSSDE TNCSAPASEPPGSL |
| C4580 | CGSNEFPCQGSDICLAPEWLCDGDDDCLDFSDEAYCSQDPEFHKVCAPNQFRCNSYDKCVPAHWVCDGVLDCLDS SDETNCSAPASEPPGSL |
| C4581 | CAPNQFRCNSYDKCVPAHWVCDGVLDCLDSSDETNCSAPASEPPGSLSDVDECVILPGPCELDCVNTFDGYLCHCA PGFGGRLCVGGGGS |
| C4582 | SDVDECVILPGPCELDCVNTFDGYLCHCAPGFGGRLCVGGGGSSDVDECVILPGPCELDCVNTFDGYLCHCAPGFG GRLCVGGGGS |
| C4583 | CEPGQFQCHSYNKCVPPAWICDGVLDCLDSSDEANCSQDPEFHKVSDVDECVILPGPCELDCVNTFDGYLCHCAPG FGGRLCVGGGGS |
| C4584 | CPAYTEFLCKDSDRCFPSEWRCDGEMDCVDGSDELHCAYHTSDVDECVILPGPCELDCVNTFDGYLCHCAPGFGG RLCVGGGGS |
| C4585 | CPGGAFMCRNTTHCLGPELVCDGVPDCPDGSDETAHCPYRTSDVDECVILPGPCELDCVNTFDGYLCHCAPGFGG RLCVGGGGS |
| C4586 | CGSNEFPCQGSDICLAPEWLCDGDDDCLDFSDEAYCSQDPEFHKVSDVDECVILPGPCELDCVNTFDGYLCHCAPG FGGRLCVGGGGS |
| C4587 | CAPNQFRCNSYDKCVPAHWVCDGVLDCLDSSDETNCSAPASEPPGSLCEPGQFQCHSYNKCVPPAWICDGVLDCL DSSDEANCSQDPEFHKV |
| C4588 | SDVDECVILPGPCELDCVNTFDGYLCHCAPGFGGRLCVGGGGSCEPGQFQCHSYNKCVPPAWICDGVLDCLDSSD EANCSQDPEFHKV |
| C4589 | CEPGQFQCHSYNKCVPPAWICDGVLDCLDSSDEANCSQDPEFHKVCEPGQFQCHSYNKCVPPAWICDGVLDCLDS SDEANCSQDPEFHKV |
| C4590 | CPAYTEFLCKDSDRCFPSEWRCDGEMDCVDGSDELHCAYHTCEPGQFQCHSYNKCVPPAWICDGVLDCLDSSDEA NCSQDPEFHKV |
| C4591 | CPGGAFMCRNTTHCLGPELVCDGVPDCPDGSDETAHCPYRTCEPGQFQCHSYNKCVPPAWICDGVLDCLDSSDEA NCSQDPEFHKV |
| C4592 | CGSNEFPCQGSDICLAPEWLCDGDDDCLDFSDEAYCSQDPEFHKVCEPGQFQCHSYNKCVPPAWICDGVLDCLDS SDEANCSQDPEFHKV |
| C4593 | CAPNQFRCNSYDKCVPAHWVCDGVLDCLDSSDETNCSAPASEPPGSLCPAYTEFLCKDSDRCFPSEWRCDGEMDC VDGSDELHCAYHT |
| C4594 | SDVDECVILPGPCELDCVNTFDGYLCHCAPGFGGRLCVGGGGSCPAYTEFLCKDSDRCFPSEWRCDGEMDCVDGS DELHCAYHT |
| C4595 | CEPGQFQCHSYNKCVPPAWICDGVLDCLDSSDEANCSQDPEFHKVCPAYTEFLCKDSDRCFPSEWRCDGEMDCVD GSDELHCAYHT |
| C4596 | CPAYTEFLCKDSDRCFPSEWRCDGEMDCVDGSDELHCAYHTCPAYTEFLCKDSDRCFPSEWRCDGEMDCVDGSD ELHCAYHT |
| C4597 | CPGGAFMCRNTTHCLGPELVCDGVPDCPDGSDETAHCPYRTCPAYTEFLCKDSDRCFPSEWRCDGEMDCVDGSD ELHCAYHT |
| C4598 | CGSNEFPCQGSDICLAPEWLCDGDDDCLDFSDEAYCSQDPEFHKVCPAYTEFLCKDSDRCFPSEWRCDGEMDCVD GSDELHCAYHT |
| C4599 | CAPNQFRCNSYDKCVPAHWVCDGVLDCLDSSDETNCSAPASEPPGSLCPGGAFMCRNTTHCLGPELVCDGVPDCP DGSDETAHCPYRT |
| C4600 | SDVDECVILPGPCELDCVNTFDGYLCHCAPGFGGRLCVGGGGSCPGGAFMCRNTTHCLGPELVCDGVPDCPDGSD ETAHCPYRT |
| C4601 | CEPGQFQCHSYNKCVPPAWICDGVLDCLDSSDEANCSQDPEFHKVCPGGAFMCRNTTHCLGPELVCDGVPDCPDG SDETAHCPYRT |

TABLE 4-continued

| Amino Acid sequences of 36 Sclerostin-neutralizing rational dimers. | |
|---|---|
| C4602 | CPAYTEFLCKDSDRCFPSEWRCDGEMDCVDGSDELHCAYHTCPGGAFMCRNTTHCLGPELVCDGVPDCPDGSDETAHCPYRT |
| C4603 | CPGGAFMCRNTTHCLGPELVCDGVPDCPDGSDETAHCPYRTCPGGAFMCRNTTHCLGPELVCDGVPDCPDGSDETAHCPYRT |
| C4604 | CGSNEFPCQGSDICLAPEWLCDGDDDCLDFSDEAYCSQDPEFHKVCPGGAFMCRNTTHCLGPELVCDGVPDCPDGSDETAHCPYRT |
| C4605 | CAPNQFRCNSYDKCVPAHWVCDGVLDCLDSSDETNCSAPASEPPGSLCGSNEFPCQGSDICLAPEWLCDGDDDCLDFSDEAYCSQDPEFHKV |
| C4606 | SDVDECVILPGPCELDCVNTFDGYLCHCAPGFGGRLCVGGGGSCGSNEFPCQGSDICLAPEWLCDGDDDCLDFSDEAYCSQDPEFHKV |
| C4607 | CEPGQFQCHSYNKCVPPAWICDGVLDCLDSSDEANCSQDPEFHKVCGSNEFPCQGSDICLAPEWLCDGDDDCLDFSDEAYCSQDPEFHKV |
| C4608 | CPAYTEFLCKDSDRCFPSEWRCDGEMDCVDGSDELHCAYHTCGSNEFPCQGSDICLAPEWLCDGDDDCLDFSDEAYCSQDPEFHKV |
| C4609 | CPGGAFMCRNTTHCLGPELVCDGVPDCPDGSDETAHCPYRTCGSNEFPCQGSDICLAPEWLCDGDDDCLDFSDEAYCSQDPEFHKV |
| C4610 | CGSNEFPCQGSDICLAPEWLCDGDDDCLDFSDEAYCSQDPEFHKVCGSNEFPCQGSDICLAPEWLCDGDDDCLDFSDEAYCSQDPEFHKV |

Sclerostin neutralizing Avimer Engineered Dimers

Sclerostin neutralizing Engineered Dimers are a further evolution of the Rational Dimers. While the Rational Dimers significantly improved Sclerostin neutralizing potency when compared to the input Avimer monomers and when compared to the Avimer walked dimers, some of the domains in the Rational Dimers are naïve Avimer monomer domains. The "Engineered Dimers" were constructed by replacing these individual naive Avimer domains in the Rational Dimers with their more potent affinity matured counterparts. A total of 20 Avimer Engineered Dimers were constructed (Table 5). When tested in the AlphaScreen inhibition assay, the engineered dimers are all potent Sclerostin blockers with seven of them having 1050 values between 50-90 pM (FIG. 6).

TABLE 5

| Sclerostin neutralizing Avimer Engineered Dimers amino acid sequence | |
|---|---|
| Avimer | Avimer amino acid sequence |
| C4885 | CGRDHFRCRSYDKCVPAHWLCDGVLDCLDSSDETYCSAPASEPPGSLCGRDHFRCRSYDKCVPAHWLCDGVLDCLDSSDETYCSAPASEPPGSL |
| C4886 | WCPPNHFMCNSYDKCVPAHWFCDGVLDCLDSSDETNCSAPASEPPGSLCPPNHFMCNSYDKCVPAHWFCDGVLDCLDSSDETNCSAPASEPPGSL |
| C4887 | WCPPNHFMCNSYDKCVPAHWFCDGVLDCLDSSDETNCSAPASEPPGSLCGRDHFRCRSYDKCVPAHWLCDGVLDCLDSSDETYCSAPASEPPGSL |
| C4888 | CPAYTEFLCKDSDRCFPSEWRCDGEMDCVDGSDELHCAYHTCGRDHFRCRSYDKCVPAHWLCDGVLDCLDSSDETYCSAPASEPPGSL |
| C4889 | CPAYTEFLCKDSDRCFPSEWRCDGEMDCVDGSDELHCAYHTCPPNHFMCNSYDKCVPAHWFCDGVLDCLDSSDETNCSAPASEPPGSL |
| C4890 | CPGGAFMCRNTTHCLGPELVCDGVPDCPDGSDETAHCPYRTCGRDHFRCRSYDKCVPAHWLCDGVLDCLDSSDETYCSAPASEPPGSL |
| C4891 | CPGGAFMCRNTTHCLGPELVCDGVPDCPDGSDETAHCPYRTCPPNHFMCNSYDKCVPAHWFCDGVLDCLDSSDETNCSAPASEPPGSL |
| C4892 | CPAYTEFLCKDSDRCFPSEWRCDGEMDCVDGSDELHCAYHTSDVDECVILPGPCELDCVNTFDDYVCHCKPSFGGVLCVGGGGS |
| C4893 | CGRDHFRCRSYDKCVPAHWLCDGVLDCLDSSDETYCSAPASEPPGSLCPAYTEFLCKDSDRCFPSEWRCDGEMDCVDGSDELHCAYHT |
| C4894 | WCPPNHFMCNSYDKCVPAHWFCDGVLDCLDSSDETNCSAPASEPPGSLCPAYTEFLCKDSDRCFPSEWRCDGEMDCVDGSDELHCAYHT |

TABLE 5-continued

Sclerostin neutralizing Avimer Engineered Dimers amino acid sequence

| Avimer | Avimer amino acid sequence |
|---|---|
| C4895 | CGRDHFRCRSYDKCVPAHWLCDGVLDCLDSSDETYCSAPASEPPGSLCGSREFPCQGTDICLPPEWICDGDDDCLDTSDEAYCSQDPEFHKV |
| C4896 | WCPPNHFMCNSYDKCVPAHWFCDGVLDCLDSSDETNCSAPASEPPGSLCGSREFPCQGTDICLPPEWICDGDDDCLDTSDEAYCSQDPEFHKV |
| C4897 | CGRDHFRCRSYDKCVPAHWLCDGVLDCLDSSDETYCSAPASEPPGSLCGSNEFPCQGSDICLAPEWLCDGDDDCLDFSDEAYCSQDPEFHKV |
| C4898 | WCPPNHFMCNSYDKCVPAHWFCDGVLDCLDSSDETNCSAPASEPPGSLCGSNEFPCQGSDICLAPEWLCDGDDDCLDFSDEAYCSQDPEFHKV |
| C4899 | CVILPGPCELDCVNTFDGYLCHCVPGFNGLNCQGGGGSCGRDHFRCRSYDKCVPAHWLCDGVLDCLDSSDETYCSAPASEPPGSL |
| C4900 | CVILPGPCELDCVNTFDGYLCHCVPGFNGLNCQGGGGSCPPNHFMCNSYDKCVPAHWFCDGVLDCLDSSDETNCSAPASEPPGSL |
| C4901 | SDVDECVILPGPCELDCVNTFDDYVCHCKPSFGGVLCVGGGGSCGRDHFRCRSYDKCVPAHWLCDGVLDCLDSSDETYCSAPASEPPGSL |
| C4902 | SDVDECVILPGPCELDCVNTFDDYVCHCKPSFGGVLCVGGGGSCPPNHFMCNSYDKCVPAHWFCDGVLDCLDSSDETNCSAPASEPPGSL |
| C4903 | CAPNQFRCNSYDKCVPAHWVCDGVLDCLDSSDETNCSAPASEPPGSLCGSNEFPCQGSDICLAPEWLCDGDDDCLDFSDEAYCGGGGSGGGGS |
| C4904 | CAPNQFRCNSYDKCVPAHWVCDGVLDCLDSSDETNCSAPASEPPGSLCGSNEFPCQGSDICLAPEWLCDGDDDCLDFSDEAYCSQDPEFSAV |

Yeast Display Sclerostin Neutralizing Avimer Monomers and Dimers.

As an alternative approach to identifying potent Sclerostin neutralizing Avimers, some of the selected monomer and dimer phage display pools where transferred into a yeast display vector and were selected for improved Sclerostin binding through six rounds by yeast display. A total of eight new Avimer dimers and four new Avimer monomers were identified (Table 6). When tested in AlphaScreen inhibition assays, all twelve yeast-derived Avimers neutralized Sclerostin between 0.5 and 1.5 nM 1050 (FIG. 7).

TABLE 6

Yeast Display Avimer amino acid sequences

| Avimer | Avimer amino acid sequence |
|---|---|
| C5019 | CAPSEFTCNNGHCIPPQWVCDGVDDCGDGSDEPPHCKATAPTCGSREFPCQGPDICLPPEWICDGDDDCLDTSDEAYCSQDPEFHKV |
| C5020 | CASGEFTCGNGYCIPLQWVCDGVDDCGDGSDETGCSQDPEFHKVCGSREFPCQGTDICLPPAWLCDGDDDCLDTPDEAYCSQDPEFHKV |
| C5021 | CASGEFTCGNGYCIPLQWVCDGVDDCGDGSDETGCSQDPEFHKVCGSREFPCQGTDICLPPEWICDGDDDCLDTPDEAYCSQDPEFHKV |
| C5022 | CPSGQFTCGNGYCIPEEWVCDGVDDCGDGSDEPPLCETAVPTCGSREFPCQGTDICLPPEWICDGDDDCLDTPDEAYCSQDPEFHKV |
| C5023 | CRANEFKCSNGHCVPREWVCDGVDDCGDGSDEPADCERAEPTCGSREFPCQGTDICLPPAWLCDGDDDCLDTPDEAYCSQDPEFHKV |
| C5024 | CPPGQFKCSNGHCIPETWVCDGVDDCGDGSDESPDCERTEPTCGSREFPCQGTDICLPPEWICDGDDDCLDTPDEAYCSQDPEFHK |
| C5025 | CPADQFRCGSGHCVPLAWVCDGVDDCADGSDEAEQCTPPTCGSYEFPCQGTDICLLPAWLCDGDADCRDYSDETDCSQDPEFHKV |
| C5026 | CPSGEFRCKNGRCIPAAWLCDGEPDCRDSSDEAGCSAPASEPPGSLCGSREFPCQGTDICLPPEWICDGDDDCLDTSDEAYCSQDPEFHKV |
| C5027 | CGSREFPCQGTDICLLPAWLCDGDADCRYYSDETDCSQDPEFHKV |
| C5028 | CGSREFPCQGTDICLPPEWICDGDDDCLETSDEAYCSQDPEFHKV |

TABLE 6-continued

Yeast Display Avimer amino acid sequences

| Avimer | Avimer amino acid sequence |
|---|---|
| C5029 | CGSREFPCQGTDLCLPPEWICDGDDDCLDTPDEAYCSQDPEFHKV |
| C5030 | CGSYEFPCQGTDICLLPAWLCDGDADCRYYSDETDCSQDPEFHKV |

New Sclerostin Neutralizing Walked Dimers.

Figure 8A:
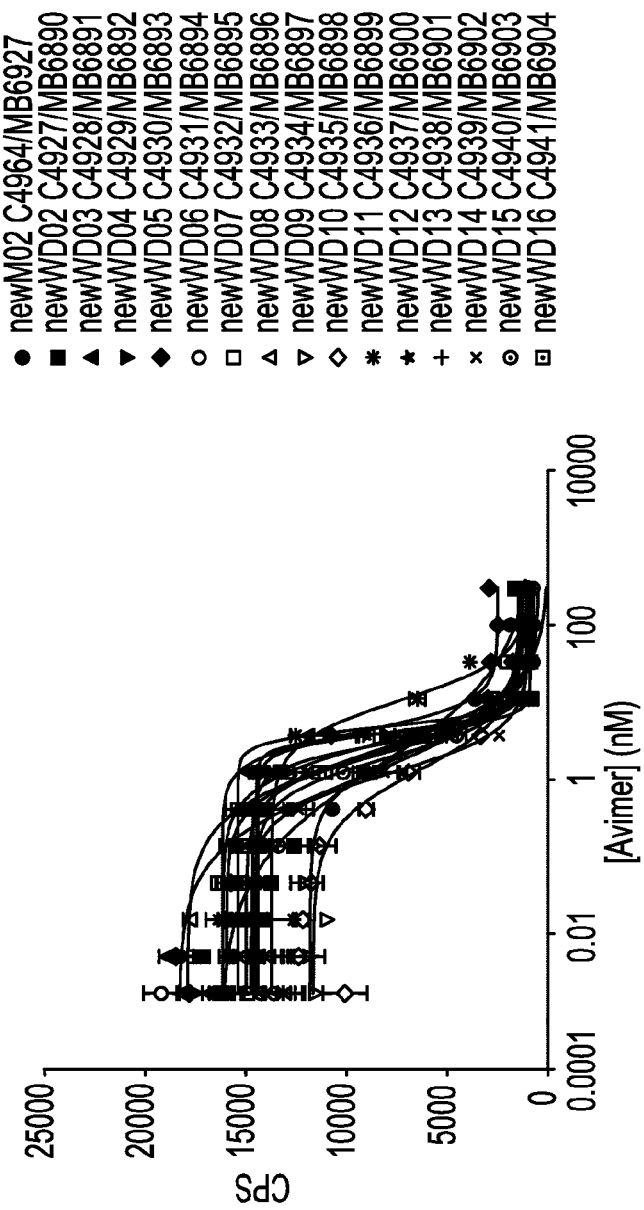
FIG. 8: Representative Avimer New walked dimers neutralize Sclerostin in AlphaScreen assays.

To improve Sclerostin neutralizing potency, additional phage display was performed under more stringent conditions. Additionally, selected phage display walked dimer pools were transferred into a yeast display vector and were selected for improved Sclerostin binding activity. A total of 39 new Avimer proteins were identified from both processes (38 walked dimers and 1 monomer) (Table 7). When tested in AlphaScreen inhibition assays, all 39 proteins neutralized Sclerostin with 1050 values between 0.6 and 10 nM (FIG. 8). When the same proteins were tested in the Wnt1 cell based assay, the potencies measured were as good as 5-6 nM (FIG. 9), which is likely the limit of detection in this assay.

TABLE 7

New Avimer walked dimers amino acid sequences

| Avimer | Avimer amino acid sequence |
|---|---|
| C4927 | CASNQFTCGNGHCLPPQWVCDGVDDCGDGSDEPADCSQDPEFHKVCGSREFPCQGTDICLPPAWLCDGDDDCLDTSDEAYCSQDPEFHKV |
| C4928 | CASSQFTCGSGRCVPVEWLCDGENDCGDGSDEAGCGRPGPGATSAPAACEPGQFQCHSYPKCVPPIWVCDGVLDCLDSSDEADCSQDPEFHKV |
| C4929 | CEASQFKCHSSGRCIPVGWVCDGENDCADGSDEPAECPARTCGSREFPCQGTDICLPPAWLCDGDDDCLDNPDEAYCSQDPEFHKV |
| C4930 | CEPGQFQCHSYNKCVPPAWICDGVLDCLDSSDEANCSQDPEFHKVCEPDQFTCRSNGRCIPLGWVCDGDNDCVDDSDEKSCSQDPEFHKV |
| C4931 | CGAGEFTCNNGRCIPEPWLCDGVDDCRDSSDEPPAHCSAPASEPPGSLCGSREFPCQGTDICLPPEWICDGDDDCLDTSDEAYCSQDPEFHKV |
| C4932 | CHPFGEFECESGKCVPLGLVCDGVNDCRDNSDEPALCSAPASEPPGSLCGSREFPCQGTDICLPPEWICDGDDDCLDTPDEAYCSQDPEFHKV |
| C4933 | CHPFGQFECGSGSCIPGAWVCDGVNDCGDGSDEPQHCGRPGPGATSAPAACPGGAFMCRNTTHCLGPELVCDGVPDCPDGSDETAHCPYRT |
| C4934 | CHPFGQFECRSGQCIPLPWLCDGEDDCADGSDEPQDCGRPGPGATSAPAACPGGAFMCRNTTHCLGPELVCDGVPDCPDGSDETAHCPYRT |
| C4935 | CHPYAEFGCSSGKCIPAPLVCDGVNDCGDGSDEPQHCSAPASEPPGSLCPAFTEFLCKDSNRCYPSEWRCDGEVDCTDGSDELHCAYHT |
| C4936 | CLPGQFPCKNGRCISEQWVCDGDNDCPDGSDESALCSQDPEFHKVCGSREFPCQGTDICLPPEWICDGDDDCLDTPDEAYCSQDPEFHKV |
| C4937 | CLSDQFQCGNGQCIPVRWVCDGVNDCGDGSDEPALCSQDPEFHKVCGSREFPCQGTDICLPPEWICDGDDDCLDTSDEAYCSQDPEFHKV |
| C4938 | CLSSQFKCSNGNCIPEQWVCDGVNDCGDGSDEPEHCTGPVHTCGSREFPCQGPDICLPPAWLCDGDDDCLDNPDEAYCSQDPEFHKV |
| C4939 | CPAFTEFLCKDSDRCFPSEWRCDGEMDCVDGSDELHCAYHTCRSGQFRCGNGHCIPPSWLCDGDNDCPDDSDEKGCSPDP |
| C4940 | CPAFTEFLCKDSNRCYPSEWRCDGEVDCTDGSDELHCAYHTCAPSEFRCSNGKCVPAQWVCDGVNDCADGSDEPQHCGDSHILPFSTPGPST |
| C4941 | CPAFTEFLCKDSNRCYPSEWRCDGEVDCTDGSDELHCAYHTCPSSQFTCRNSGKCIPRPLLCDGDNDCGDDSDEPLAHCSAPASEPPGSL |
| C4942 | CPAGQFTCGNGHCIPLPWLCDGANDCGDGSDEAPQCETAAPTCGSREFPCQGPDICLPPEWICDGDDDCLETSDEAYCSQDPEFHKV |

TABLE 7-continued

New Avimer walked dimers amino acid sequences

| Avimer | Avimer amino acid sequence |
|---|---|
| C4943 | CPAGQFTCSNGHCIPVQWVCDGVDDCGDGSDESAVCSQDPEFHKVCGSREFPCQGTDICLPPEWICDGDDDCLDTPDEAYCSQDPEFHKV |
| C4944 | CPASQFKCENGNCIPGHWVCDGVDDCGDNSDEASCSQDPEFHKVCGSREFPCQGTDICLPPAWLCDGDDDCLDNPDEAYCSQDPEFHKV |
| C4945 | CPAYTEFLCKDSDRCFPSEWRCDGEMDCVDGSDELHCAYHACPSNQFTCSNGNCLSLAWLCDGVPDCGDDSDEANCGRPGPGATSAPAA |
| C4946 | CPAYTEFLCKDSDRCFPSEWRCDGEMDCVDGSDELHCAYHTCAPNQFRCNSYDKCVPAHWVCDGVLDCLDNSDEADCTATVPT |
| C4947 | CPAYTEFLCKDSDRCFPSEWRCDGEMDCVDGSDELHCAYHTCPSSQFQCHNSETCIPQTWVCDGADDCQDDSDEKSCSAPASEPPGSL |
| C4948 | CPAYTEFLCKDSDRCFPSEWRCDGEMDCVDGSDELHCAYHTCVADQFRCDNGKCISENLGCDGDNDCPDGSDEAGCGRPGPGATSAPAA |
| C4949 | CPAYTEFLCKDSDRCFPSEWRCDGEMDCVDGSDELHCAYHTCVPNEFPCSNGHCLSEPWGCDGDDDCRDGSDEPPDCETSGRT |
| C4950 | CPAYTEFLCKDSNRCYPSEWRCDGEVDCTDGSDELHCAYHTCGSGQFRCNSYDKCVPAHWVCDGVLDCLDSSDETNCSAPASEPPGSL |
| C4951 | CPPNQFQCGSGRCIPEHWVCDGENDCGDGSDEPAVCSAPASEPPGSLCGSREFPCQGTDICLPPAWLCDGDDDCLDNPDEAYCSQDPEFHKV |
| C4952 | CPPSQFPCDSGKCIPVHWVCDGENDCRDGSDEPALCSAPASEPPGSLCGSREFPCQGTDICLPPAWLCDGDDDCLDNPDEAYCSQDPEFHKV |
| C4953 | CPSDQFQCGNGHCIPAPWVCDGVDDCGDGSDEPQHCTTSEPTCGSREFPCQGTDICLPPAWLCDGDDDCLDNPDEAYCSQDPEFHKV |
| C4954 | CQPSQFPCGNGHCIPEQWLCDGVNDCGDGSDEPELCTRSEPTCGSREFPCQGTDICLPPEWICDGDDDCLDTSDEAYCSQDPEFHKV |
| C4955 | CQSGQFQCNSGQCIPREWVCDGVPDCGDGSDEPEDCTTSAHTCGSREFPCQGTDICLPPEWICDGDDDCLDTPDEAYCSQDPEFHKV |
| C4956 | CRAGEFQCNSGHCIPLPWLCDGVPDCGDGSDEPAVCAGSVPTCGSREFPCQGTDICLPPAWLCDGDDDCLDNPDEAYCSQDPEFHKG |
| C4957 | CRPSEFPCKSGHCISPQWGCDGDPDCGDNSDEPPDPCSAPASEPPGSLCGSSEFPCQGTDICLPPEWICDGDDDCLETSDEAYCSQDPEFHKV |
| C4958 | CRSDEFRCRNGHCIPGRWVCDGVDDCGDGSDETDCSAPASEPPGSLCGSREFPCQGTDICLPPEWICDGDDDCLETSDEAYCSQDPEFHKV |
| C4959 | CRSDEFTCKNGHCIPGRWVCDGVDDCGDGSDEEGCSAPASEPSGSLCGSREFPCQGTDICLPPAWLCDGDDDCLDNPDEAYCSQDPEFHKV |
| C4960 | CRSDQFTCGNGHCIPARWVCDGVDDCGDGSDEPEHCSQDPEFHKVCGSREFPCQGTDICLPPAWLCDGDDDCLDNPDEAYCSQDPEFHKV |
| C4961 | CVSGQFTCDSGKCVSAAWLCDGENDCGDGSDEPQVCSAPASEPPGSLCQPGQFQCHSYPKCVPPIWVCDGVLDCLDSSDEADCSQDPEFHKV |
| C4962 | CVSGQFTCGNGKCVSQTWLCDGEDDCGDDSDEKDCSAPASEPPGSLCQPGQFQCHSYPKCVPPIWVCDGVLDCLDSSDEADCSQDPEFHKV |
| C4963 | SDVDECFANPCPTGVCVNTSDGFTCDCEPGFDGNSCEVEQVSSDVDECVILPGPCELDCVNTFDGYLCHCAPSFGGRLCVGGGGS |
| C4964 | CPDFTEFLCKDSNRCYPSEWRCDGEMDCADGSDELHCAYHT |

New Avimer WD17- and WD25-Antibody Fusions

Figure 11A:
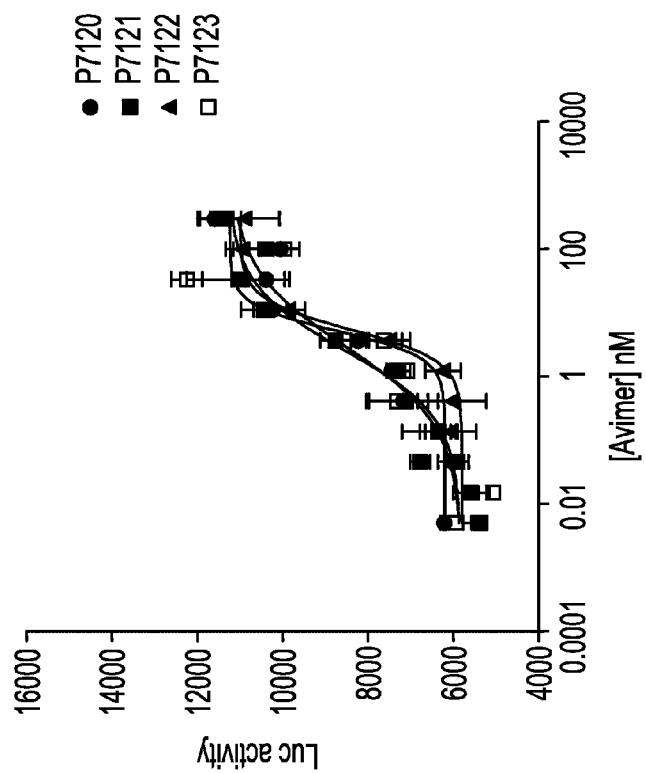
FIG. 11: Avimer New WD17- and WD25-antibody fusions neutralize Sclerostin in the Wnt1 cell based assay.
Figure 11B:
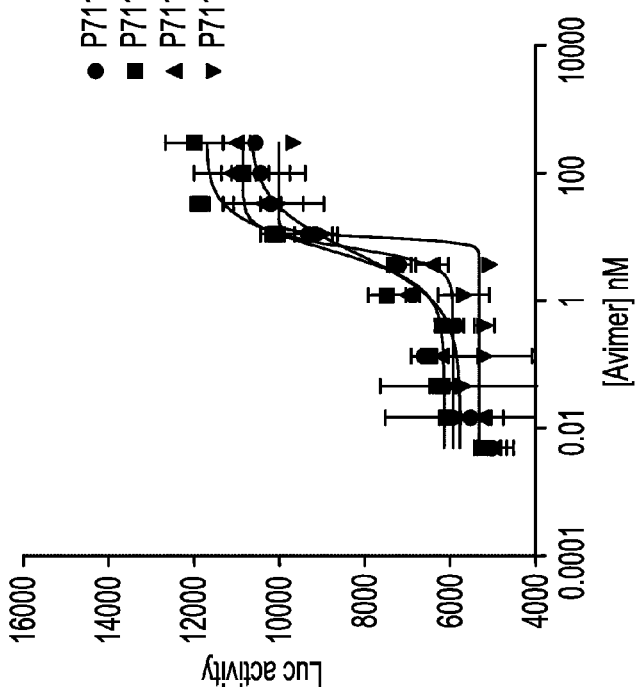

Two Sclerostin neutralizing Avimers walked dimers, newWD17 (C4942) and newWD25 (C4950), were fused singly to the N- or C-terminus of either the heavy chain or light chain of the Dkk-1 neutralizing antibody 6.147.4. The clones representing the eight combinations of Avimer and antibody fusion formats are listed in Table 8. All eight Avimer-antibody fusions neutralize Sclerostin in AlphaScreen assays, with most 1050 potencies between 0.09 and 1.2 nM except the Avimer-light chain fusions which are between 5 and 30 nM (FIG. 10). The eight Avimer-antibody fusions were tested in the Wnt1 cell based assay and all had single digit nM 1050 potencies, which is at the limit of detection for the assay (FIG. 11).

TABLE 8

Avimer New WD17- and WD25-antibody fusion amino acid sequences.

| LMR Seq Set | LMR Seq | FMP Batch ID | Full AA Seq |
|---|---|---|---|
| SS-12952 | SEQ-60233 | P7116 | MAWTVLLLGLLSHCTGSVTSSGGSCPAGQFTCGNGHCIPLPWLCDGANDCGDGSDE APQCETAAPTCGSREFPCQGPDICLPPEWICDGDDDCLETSDEAYCSQDPEFHKVSYV LTQPPSVSVAPGQTARITCGGNNIGSKSVHWYQQKPGQAPVLVVYDDSDRPSEIPERF SGSNSGNTATLTISRVEAGDEADYYCQVWDSSSDHVVFGGGTRLTVLGQPKAAPSVT LFPPSSEELQANKATLVCLISDFYPGAVTVAWKADSSPVKAGVETTTPSKQSNNKYAAS SYLSLTPEQWKSHRSYSCQVTHEGSTVEKTVAPTECS |
| SS-12966 | SEQ-60234 | P7117 | MAWTVLLLGLLSHCTGSVTSSGGSCPAYTEFLCKDSNRCYPSEWRCDGEVDCTDGSD ELHCAYHTCGSGQFRCNSYDKCVPAHWVCDGVLDCLDSSDETNCSAPASEPPGSLSY VLTQPPSVSVAPGQTARITCGGNNIGSKSVHWYQQKPGQAPVLVVYDDSDRPSEIPE RFSGSNSGNTATLTISRVEAGDEADYYCQVWDSSSDHVVFGGGTRLTVLGQPKAAPS VTLFPPSSEELQANKATLVCLISDFYPGAVTVAWKADSSPVKAGVETTTPSKQSNNKYA ASSYLSLTPEQWKSHRSYSCQVTHEGSTVEKTVAPTECS* |
| SS-12967 | SEQ-60259 | P7118 | MAWTVLLLGLLSHCTGSVTSYVLTQPPSVSVAPGQTARITCGGNNIGSKSVHWYQQK PGQAPVLVVYDDSDRPSEIPERFSGSNSGNTATLTISRVEAGDEADYYCQVWDSSSDH VVFGGGTRLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS SSGGSCPAGQFTCGNGHCIPLPWLCDGANDCGDGSDEAPQCETAAPTCGSREFPCQ GPDICLPPEWICDGDDDCLETSDEAYCSQDPEFHKVSLQ* |
| SS-12968 | SEQ-60260 | P7119 | MAWTVLLLGLLSHCTGSVTSYVLTQPPSVSVAPGQTARITCGGNNIGSKSVHWYQQK PGQAPVLVVYDDSDRPSEIPERFSGSNSGNTATLTISRVEAGDEADYYCQVWDSSSDH VVFGGGTRLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS SSGGSCPAYTEFLCKDSNRCYPSEWRCDGEVDCTDGSDELHCAYHTCGSGQFRCNSY DKCVPAHWVCDGVLDCLDSSDETNCSAPASEPPGSLSLQ* |
| SS-12969 | SEQ-60261 | P7120 | MEFGLSWVFLVALLRGVQCSGGSCPAGQFTCGNGHCIPLPWLCDGANDCGDGSDE APQCETAAPTCGSREFPCQGPDICLPPEWICDGDDDCLETSDEAYCSQDPEFHKVSQV QLVESGGGVVQPGRSLRLSCAASGFTFSRYDMHWVRQAPGKGLEWVAIIFYDGSNKY YADPVKGRFTISRDNSKNTLYLQMNSLRAEDTAVYYCATLAAAFDYWGQGTLVTVSS ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGPS VFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHNHYTQKSLSLSPGK* |
| SS-12970 | SEQ-60262 | P7121 | MEFGLSWVFLVALLRGVQCSGGSCPAYTEFLCKDSNRCYPSEWRCDGEVDCTDGSDE LHCAYHTCGSGQFRCNSYDKCVPAHWVCDGVLDCLDSSDETNCSAPASEPPGSLSQV QLVESGGGVVQPGRSLRLSCAASGFTFSRYDMHWVRQAPGKGLEWVAIIFYDGSNKY YADPVKGRFTISRDNSKNTLYLQMNSLRAEDTAVYYCATLAAAFDYWGQGTLVTVSS ASTKGPSVFPLAPCSRSTSESTAALGCLVKDYFPEPVTVSWNSGALTSGVHTFPAVLQS SGLYSLSSVVTVPSSNFGTQTYTCNVDHKPSNTKVDKTVERKCCVECPPCPAPPVAGPS VFLFPPKPKDTLMISRTPEVTCVVVDVSHEDPEVQFNWYVDGVEVHNAKTKPREEQF NSTFRVVSVLTVVHQDWLNGKEYKCKVSNKGLPAPIEKTISKTKGQPREPQVYTLPPSR EEMTKNQVSLTCLVKGFYPSDIAVEWESNGQPENNYKTTPPMLDSDGSFFLYSKLTVD KSRWQQGNVFSCSVMHEALHNHYTQKSLSLSPGK* |
| SS-12971 | SEQ-60264 | P7122 | MEFGLSWVFLVALLRGVQCQVQLVESGGGVVQPGRSLRLSCAASGFTFSRYDMHWV RQAPGKGLEWVAIIFYDGSNKYYADPVKGRFTISRDNSKNTLYLQMNSLRAEDTAVYY CATLAAAFDYWGQGTLVTVSSASTKGPSVFPLAPCSRSTSESTAALGCLVKDYFPEPVT VSWNSGALTSGVHTFPAVLQSSGLYSLSSVVTVPSSNFGTQTYTCNVDHKPSNTKVDK TVERKCCVECPPCPAPPVAGPSVFLFPPKPKDTLMISRTPEVTCVVVDVSHEDPEVQFN WYVDGVEVHNAKTKPREEQFNSTFRVVSVLTVVHQDWLNGKEYKCKVSNKGLPAPIE KTISKTKGQPREPQVYTLPPSREEMTKNQVSLTCLVKGFYPSDIAVEWESNGQPENNY KTTPPMLDSDGSFFLYSKLTVDKSRWQQGNVFSCSVMHEALHNHYTQKSLSLSPGKSS GGSCPAGQFTCGNGHCIPLPWLCDGANDCGDGSDEAPQCETAAPTCGSREFPCQGP DICLPPEWICDGDDDCLETSDEAYCSQDPEFHKVSLQ* |
| SS-12972 | SEQ-60265 | P7123 | MEFGLSWVFLVALLRGVQCQVQLVESGGGVVQPGRSLRLSCAASGFTFSRYDMHWV RQAPGKGLEWVAIIFYDGSNKYYADPVKGRFTISRDNSKNTLYLQMNSLRAEDTAVYY CATLAAAFDYWGQGTLVTVSSASTKGPSVFPLAPCSRSTSESTAALGCLVKDYFPEPVT VSWNSGALTSGVHTFPAVLQSSGLYSLSSVVTVPSSNFGTQTYTCNVDHKPSNTKVDK TVERKCCVECPPCPAPPVAGPSVFLFPPKPKDTLMISRTPEVTCVVVDVSHEDPEVQFN WYVDGVEVHNAKTKPREEQFNSTFRVVSVLTVVHQDWLNGKEYKCKVSNKGLPAPIE KTISKTKGQPREPQVYTLPPSREEMTKNQVSLTCLVKGFYPSDIAVEWESNGQPENNY KTTPPMLDSDGSFFLYSKLTVDKSRWQQGNVFSCSVMHEALHNHYTQKSLSLSPGKSS GGSCPAYTEFLCKDSNRCYPSEWRCDGEVDCTDGSDELHCAYHTCGSGQFRCNSYDK CVPAHWVCDGVLDCLDSSDETNCSAPASEPPGSLSLQ* |

Original Avimer-Antibody Fusions

Figure 12:
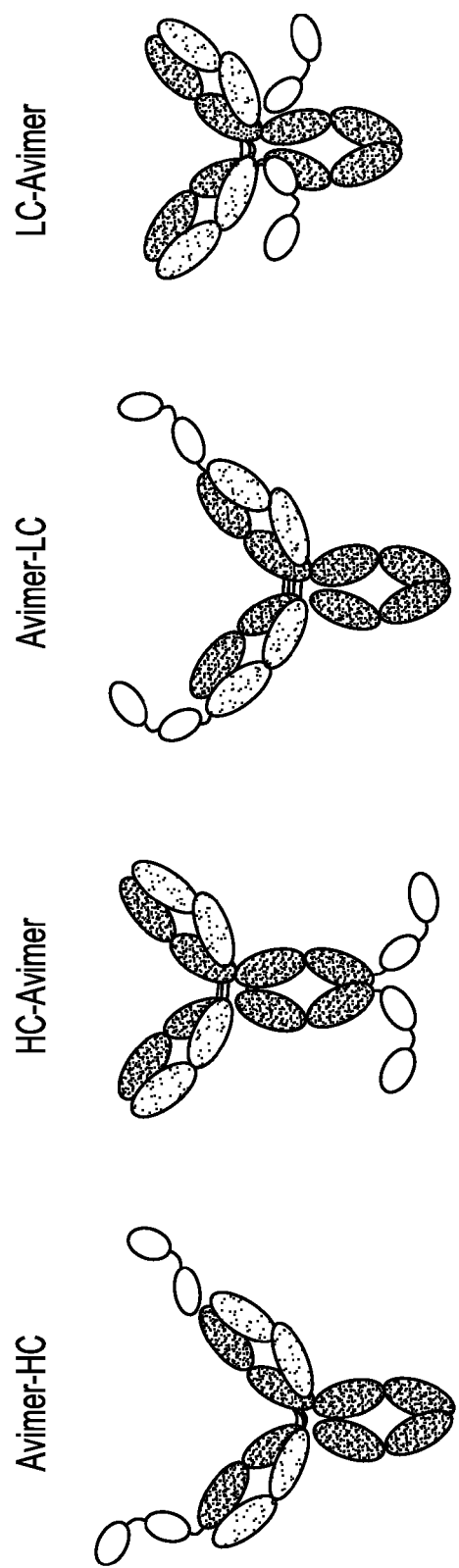
FIG. 12: Four Avimer-antibody fusion formats.
Figure 13B:
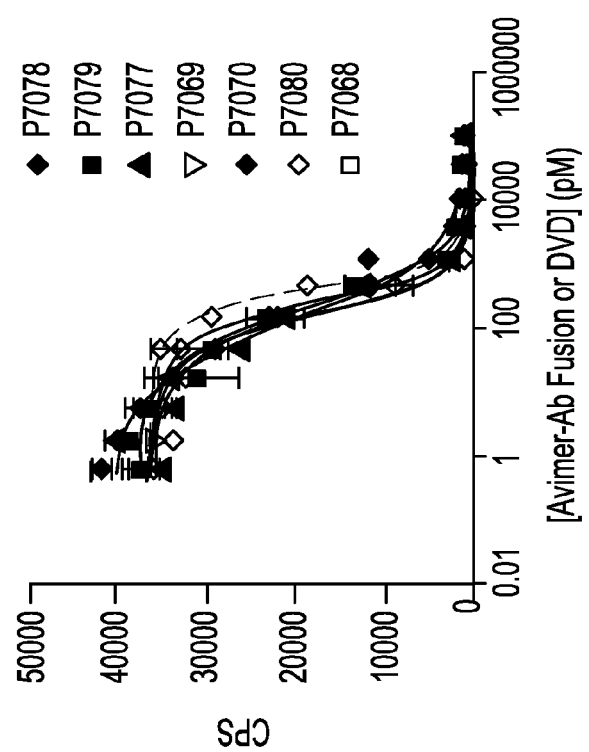
FIG. 13: AlphaScreen inhibition of the top seven Sclerostin-neutralizing Avimer-Ab fusions.
Figure 13A:
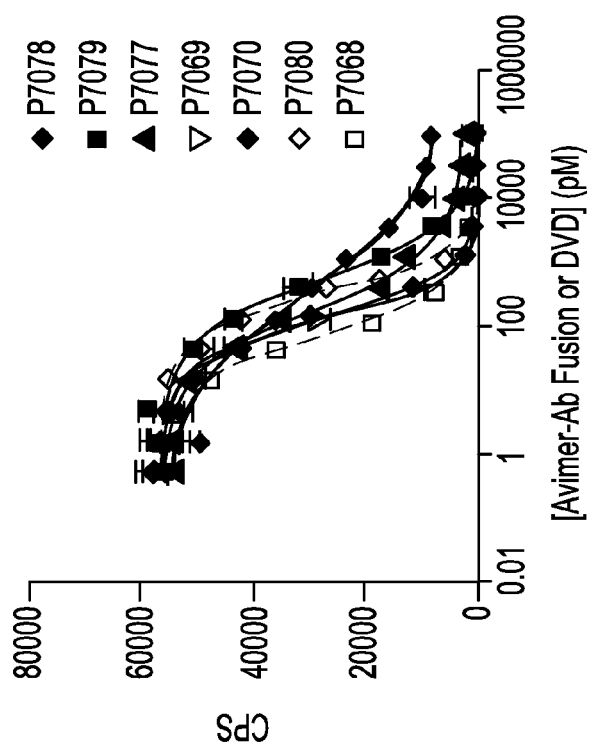
Figure 15A:
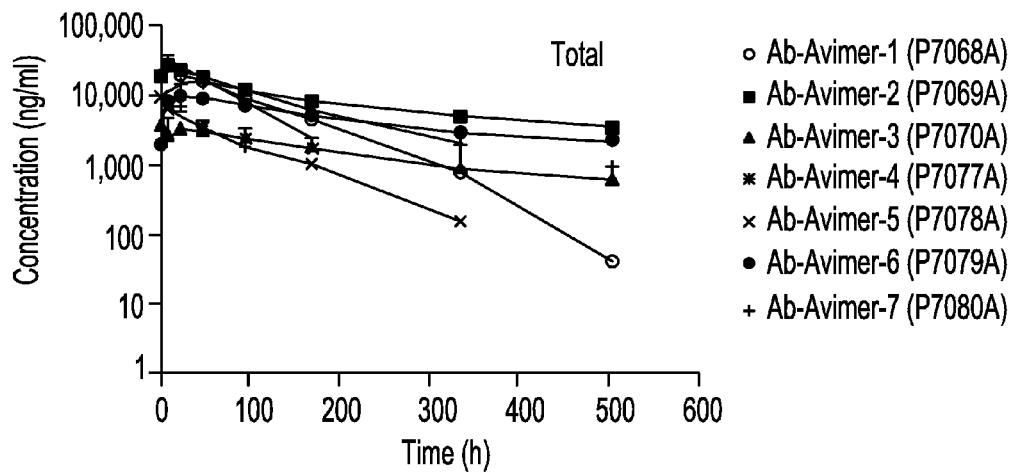
FIG. 15: Top 7 Avimer-Ab fusion PK exposure in rats.
Figure 15B:
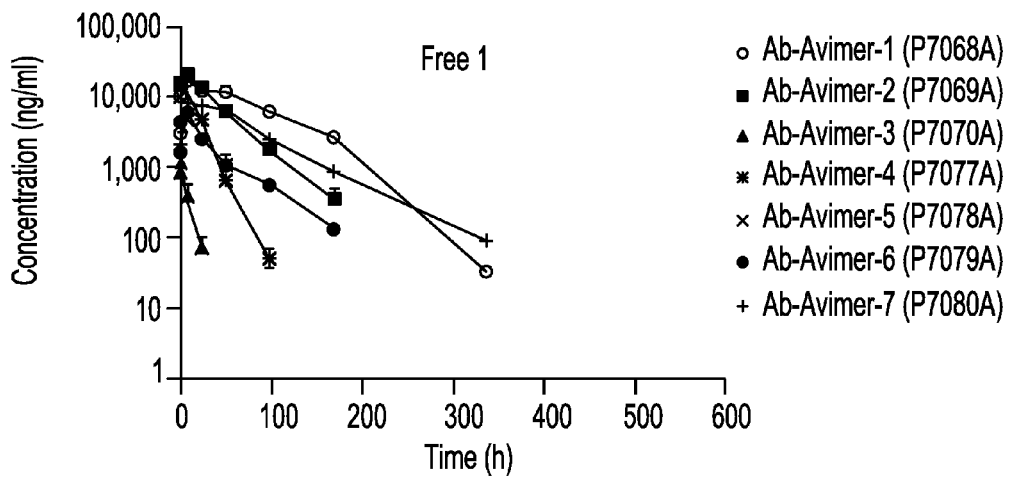
Figure 16A:
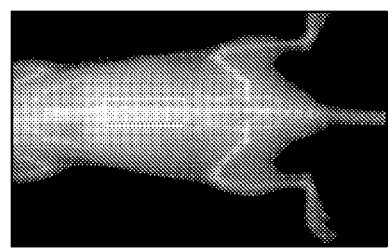
FIG. 16: Avimer-Ab fusions increase bone mineral density and bone mineral content over baseline. Avimer-1 is P7068, Avimer-2 is P7069, Avimer-3 is P7078 and Avimer-4 is P7080.
Figure 16B:
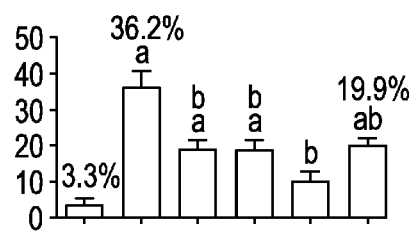
Figure 16C:
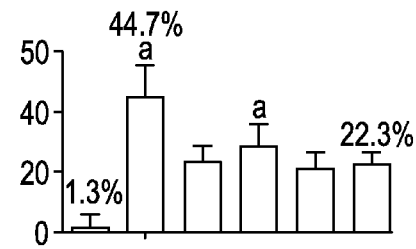
Figure 16D:
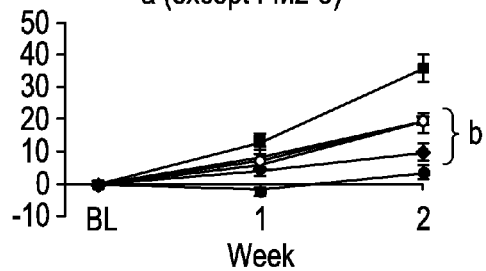
Figure 16E:
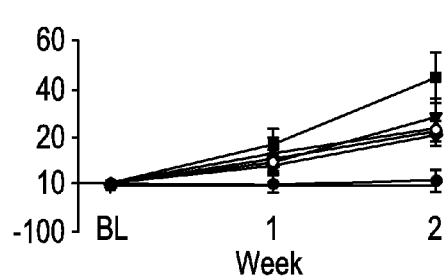

In order to fuse the Sclerostin-neutralizing Avimers with the DU-1 neutralizing antibodies, the top eight Sclerostin-neutralizing Avimers were selected from both the previous Rational Dimers set and the Engineered Dimers set. These were then singly fused to either the N-term or C-term of each heavy chain or light chain of two Dkk-1 neutralizing antibodies. In this manner, a single Avimer-antibody molecule has two potential Dkk-1 binding sites (from the antibody) and two potential Sclerostin binding sites (from the Avimer fused to either the heavy chains or the light chains). The four fusion formats are shown in FIG. 12. A total combination of 64 Avimer-Ab fusions were made and screened for expression level, aggregation level and in vitro potency. The seven best Avimer-antibody fusions were chosen and represent three fusion formats for one Dkk-1 antibody (Table 9). These seven top Avimer-antibody fusions were tested in a variety of assays: (1) they block rat Sclerostin/LRP6 and human Sclerostin/LRP6 interactions with 1050 potencies as low as 80-120 pM in AlphaScreen (FIG. 13); (2) they block both the Sclerostin/LRP6 interaction as well as the Dkk-1/LRP6 interaction simultaneously in the Wnt1 cell based assay at levels close to the detection limit (FIG. 14); (3) They have pharmacokinetic exposure in rats that is characterized by a good "total" PK (based on all the molecules present in the serum) while the intact or "free1" PK is reduced (FIG. 15 and Table 10); five of the top 7 Avimer-antibody fusions were tested in the young mouse PD study and were able to increase both bone mineral density as well as bone mineral content in the lumbar vertebrae 1-5 significantly over baseline (FIG. 16).

TABLE 9

Top 7 Avimer-antibody amino acid sequences

| FMP batch ID's | | N-terminus | C-terminus | Amino Acid Sequence |
|---|---|---|---|---|
| P7011 | P7068 | C4578 | 6.147.4 HC | SGGGSCPAYTEFLCKDSDRCFPSEWRCDGEMDCVDGSDELHCAYHTCAP NQFRCNSYDKCVPAHWVCDGVLDCLDSSDETNCSAPASEPPGSLSQVQ LVESGGGVVQPGRSLRLSCAASGFTFSRYDMHWVRQAPGKGLEWVAIIF YDGSNKYYADPVKGRFTISRDNSKNTLYLQMNSLRAEDTAVYYCATLAAA FDYWGQGTLVTVSSASTKGPSVFPLAPCSRSTSESTAALGCLVKDYFPEPV TVSWNSGALTSGVHTFPAVLQSSGLYSLSSVVTVPSSNFGTQTYTCNVDH KPSNTKVDKTVERKCCVECPPCPAPPVAGPSVFLFPPKPKDTLMISRTPEV TCVVVDVSHEDPEVQFNWYVDGVEVHNAKTKPREEQFNSTFRVVSVLT VVHQDWLNGKEYKCKVSNKGLPAPIEKTISKTKGQPREPQVYTLPPSREE MTKNQVSLTCLVKGFYPSDIAVEWESNGQPENNYKTTPPMLDSDGSFFL YSKLTVDKSRWQQGNVFSCSVMHEALHNHYTQKSLSLSPGK |
| P6991 | P7069 | 6.147.4 HC | C4578 | QVQLVESGGGVVQPGRSLRLSCAASGFTFSRYDMHWVRQAPGKGLEW VAIIFYDGSNKYYADPVKGRFTISRDNSKNTLYLQMNSLRAEDTAVYYCAT LAAAFDYWGQGTLVTVSSASTKGPSVFPLAPCSRSTSESTAALGCLVKDYF PEPVTVSWNSGALTSGVHTFPAVLQSSGLYSLSSVVTVPSSNFGTQTYTC NVDHKPSNTKVDKTVERKCCVECPPCPAPPVAGPSVFLFPPKPKDTLMIS RTPEVTCVVVDVSHEDPEVQFNWYVDGVEVHNAKTKPREEQFNSTFRV VSVLTVVHQDWLNGKEYKCKVSNKGLPAPIEKTISKTKGQPREPQVYTLP PSREEMTKNQVSLTCLVKGFYPSDIAVEWESNGQPENNYKTTPPMLDSD GSFFLYSKLTVDKSRWQQGNVFSCSVMHEALHNHYTQKSLSLSPGKSSG GSCPAYTEFLCKDSDRCFPSEWRCDGEMDCVDGSDELHCAYHTCAPNQ FRCNSYDKCVPAHWVCDGVLDCLDSSDETNCSAPASEPPGSLSLQ |
| P6992 | P7070 | 6.147.4 HC | C4894 | QVQLVESGGGVVQPGRSLRLSCAASGFTFSRYDMHWVRQAPGKGLEW VAIIFYDGSNKYYADPVKGRFTISRDNSKNTLYLQMNSLRAEDTAVYYCAT LAAAFDYWGQGTLVTVSSASTKGPSVFPLAPCSRSTSESTAALGCLVKDYF PEPVTVSWNSGALTSGVHTFPAVLQSSGLYSLSSVVTVPSSNFGTQTYTC NVDHKPSNTKVDKTVERKCCVECPPCPAPPVAGPSVFLFPPKPKDTLMIS RTPEVTCVVVDVSHEDPEVQFNWYVDGVEVHNAKTKPREEQFNSTFRV VSVLTVVHQDWLNGKEYKCKVSNKGLPAPIEKTISKTKGQPREPQVYTLP PSREEMTKNQVSLTCLVKGFYPSDIAVEWESNGQPENNYKTTPPMLDSD GSFFLYSKLTVDKSRWQQGNVFSCSVMHEALHNHYTQKSLSLSPGKSSG GSWCPPNHFMCNSYDKCVPAHWFCDGVLDCLDSSDETNCSAPASEPP GSLCPAYTEFLCKDSDRCFPSEWRCDGEMDCVDGSDELHCAYHTSLQ |
| P6888 | P7077 | 6.147.4 HC | C4893 | QVQLVESGGGVVQPGRSLRLSCAASGFTFSRYDMHWVRQAPGKGLEW VAIIFYDGSNKYYADPVKGRFTISRDNSKNTLYLQMNSLRAEDTAVYYCAT LAAAFDYWGQGTLVTVSSASTKGPSVFPLAPCSRSTSESTAALGCLVKDYF PEPVTVSWNSGALTSGVHTFPAVLQSSGLYSLSSVVTVPSSNFGTQTYTC NVDHKPSNTKVDKTVERKCCVECPPCPAPPVAGPSVFLFPPKPKDTLMIS RTPEVTCVVVDVSHEDPEVQFNWYVDGVEVHNAKTKPREEQFNSTFRV VSVLTVVHQDWLNGKEYKCKVSNKGLPAPIEKTISKTKGQPREPQVYTLP PSREEMTKNQVSLTCLVKGFYPSDIAVEWESNGQPENNYKTTPPMLDSD GSFFLYSKLTVDKSRWQQGNVFSCSVMHEALHNHYTQKSLSLSPGKSSG GSCGRDHFRCRSYDKCVPAHWLCDGVLDCLDSSDETYCSAPASEPPGSL CPAYTEFLCKDSDRCFPSEWRCDGEMDCVDGSDELHCAYHTSLQ |
| P6886 | P7078 | C4894 | 6.147.4 HC | SGGSWCPPNHFMCNSYDKCVPAHWFCDGVLDCLDSSDETNCSAPASEP PGSLCPAYTEFLCKDSDRCFPSEWRCDGEMDCVDGSDELHCAYHTSQV QLVESGGGVVQPGRSLRLSCAASGFTFSRYDMHWVRQAPGKGLEWVAI IFYDGSNKYYADPVKGRFTISRDNSKNTLYLQMNSLRAEDTAVYYCATLA AAFDYWGQGTLVTVSSASTKGPSVFPLAPCSRSTSESTAALGCLVKDYFPE PVTVSWNSGALTSGVHTFPAVLQSSGLYSLSSVVTVPSSNFGTQTYTCNV |

TABLE 9-continued

Top 7 Avimer-antibody amino acid sequences

| FMP batch ID's | | N-terminus | C-terminus | Amino Acid Sequence |
|---|---|---|---|---|
| | | | | DHKPSNTKVDKTVERKCCVECPPCPAPPVAGPSVFLFPPKPKDTLMISRT<br>PEVTCVVVDVSHEDPEVQFNWYVDGVEVHNAKTKPREEQFNSTFRVVS<br>VLTVVHQDWLNGKEYKCKVSNKGLPAPIEKTISKTKGQPREPQVYTLPPS<br>REEMTKNQVSLTCLVKGFYPSDIAVEWESNGQPENNYKTTPPMLDSDGS<br>FFLYSKLTVDKSRWQQGNVFSCSVMHEALHNHYTQKSLSLSPGK |
| P6887 | P7079 | 6.147.4 HC | C4593 | QVQLVESGGGVVQPGRSLRLSCAASGFTFSRYDMHWVRQAPGKGLEW<br>VAIIFYDGSNKYYADPVKGRFTISRDNSKNTLYLQMNSLRAEDTAVYYCAT<br>LAAAFDYWGQGTLVTVSSASTKGPSVFPLAPCSRSTSESTAALGCLVKDYF<br>PEPVTVSWNSGALTSGVHTFPAVLQSSGLYSLSSVVTVPSSNFGTQTYTC<br>NVDHKPSNTKVDKTVERKCCVECPPCPAPPVAGPSVFLFPPKPKDTLMIS<br>RTPEVTCVVVDVSHEDPEVQFNWYVDGVEVHNAKTKPREEQFNSTFRV<br>VSVLTVVHQDWLNGKEYKCKVSNKGLPAPIEKTISKTKGQPREPQVYTLP<br>PSREEMTKNQVSLTCLVKGFYPSDIAVEWESNGQPENNYKTTPPMLDSD<br>GSFFLYSKLTVDKSRWQQGNVFSCSVMHEALHNHYTQKSLSLSPGKSSG<br>GSCAPNQFRCNSYDKCVPAHWVCDGVLDCLDSSDETNCSAPASEPPGSL<br>CPAYTEFLCKDSDRCFPSEWRCDGEMDCVDGSDELHCAYHTSLQ |
| P7009 | P7080 | 6.147.4 LC | C4578 | YVLTQPPSVSVAPGQTARITCGGNNIGSKSVHWYQQKPGQAPVLVVYD<br>DSDRPSEIPERFSGSNSGNTATLTISRVEAGDEADYYCQVWDSSSDHVVF<br>GGGTRLTVLGQPKAAPSVTLFPPSSEELQANKATLVCLISDFYPGAVTVA<br>WKADSSPVKAGVETTTPSKQSNNKYAASSYLSLTPEQWKSHRSYSCQVT<br>HEGSTVEKTVAPTECSSSGGSCPAYTEFLCKDSDRCFPSEWRCDGEMDC<br>VDGSDELHCAYHTCAPNQFRCNSYDKCVPAHWVCDGVLDCLDSSDETN<br>CSAPASEPPGSLSLQ |

TABLE 10

Total and intact (Free1) PK parameters in rats

| Compound | SC Dose (mg/kg) | $T_{1/2}$ (h) | $AUC_{0\text{-}inf}$ (ng · h/mL) | Vz/F (mL/kg) | CL/F (mL/h/ kg) | MRT (h) |
|---|---|---|---|---|---|---|
| PK SOST/FC (Free 1) | | | | | | |
| Ab-Avimer-2 (P7069A) | 5 | 27 | 965,082 | 203 | 5.182 | 39 |
| Ab-Avimer-7 (P7080A) | 5 | 49 | 712,537 | 525 | 7.357 | 73 |
| Ab-Avimer-6 (P7079A) | 5 | 36 | 222,049 | 1,252 | 23.422 | 47 |
| Ab-Avimer-1 (P7068A) | 5 | 36 | 1,468,242 | 179 | 3.434 | 71 |
| Ab-Avimer-3 (P7070A) | 5 | 6 | 10,699 | 6,845 | 698.946 | 10 |
| Ab-Avimer-4 (P7077A) | 5 | 11 | 239,507 | 423 | 25.803 | 17 |
| Ab-Avimer-5 (P7078A) | 5 | 20 | 199,431 | 821 | 27.178 | 31 |
| PK FC/FC (Total) | | | | | | |
| Anti- DKK1, Ab 6.147 | 5 (IV) | 356 | 28,091,027 | 90 | 0.178 | 508 |
| Ab-Avimer-2 (P7069A) | 5 | 140 | 4,248,248 | 237 | 1.188 | 204 |
| Ab-Avimer-7 (P7080A) | 5 | 117 | 2,877,116 | 299 | 1.755 | 173 |
| Ab-Avimer-6 (P7079A) | 5 | 180 | 2,710,629 | 519 | 2.120 | 262 |
| Ab-Avimer-1 (P7068A) | 5 | 56 | 2,226,980 | 181 | 2.245 | 95 |
| Ab-Avimer-3 (P7070A) | 5 | 138 | 822,834 | 1,349 | 7.870 | 209 |
| Ab-Avimer-4 (P7077A) | 5 | 86 | 822,362 | 767 | 6.112 | 112 |
| Ab-Avimer-5 (P7078A) | 5 | 66 | 556,017 | 868 | 9.065 | 96 |

Round 1 Re-engineered Sclerostin-neutralizing Avimers

Figure 17A:
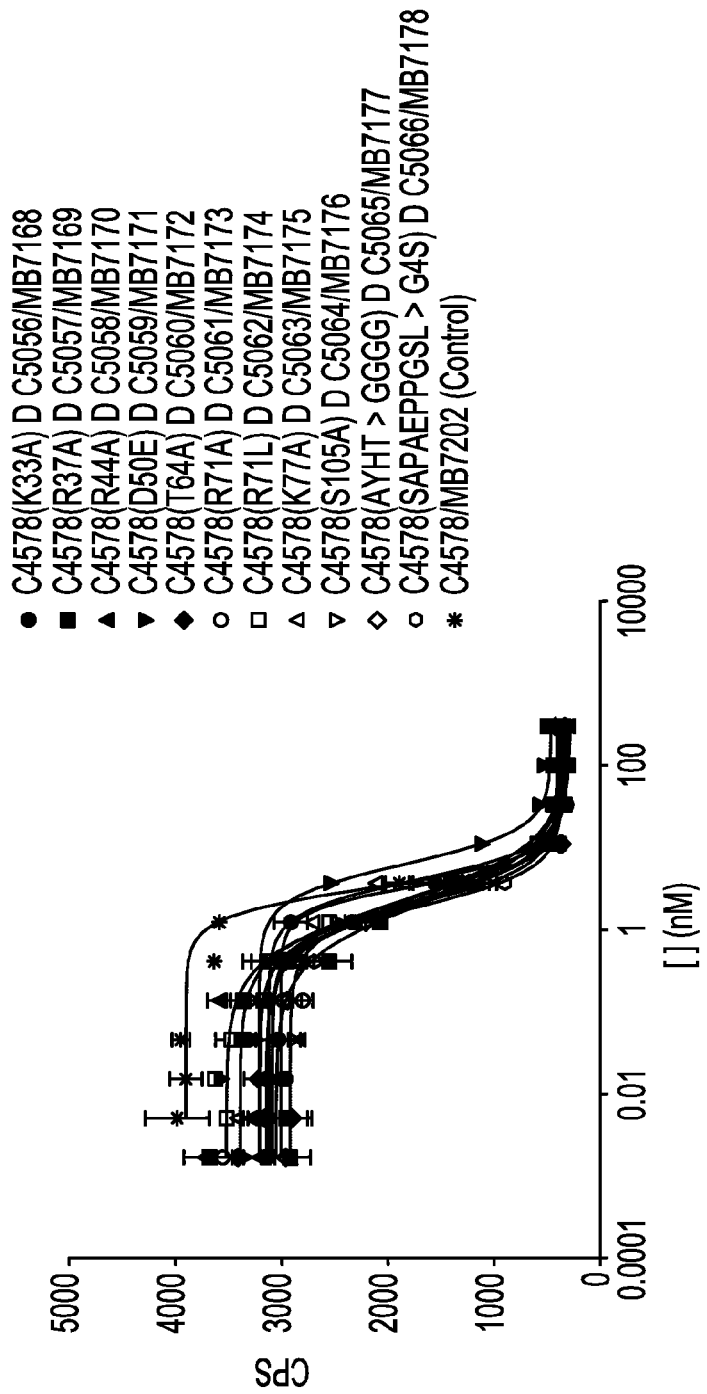
FIG. 17: Representative AlphaScreen inhibition showing round 1 mutations typically do not affect potency.
Figure 18B:
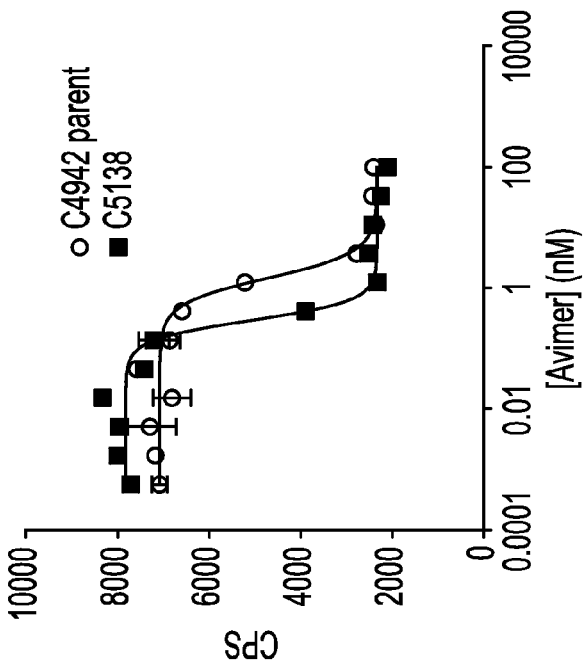
FIG. 18: Representative AlphaScreen inhibition of Round 2 Re-engineered Sclerostin neutralizing Avimers.
Figure 18A:
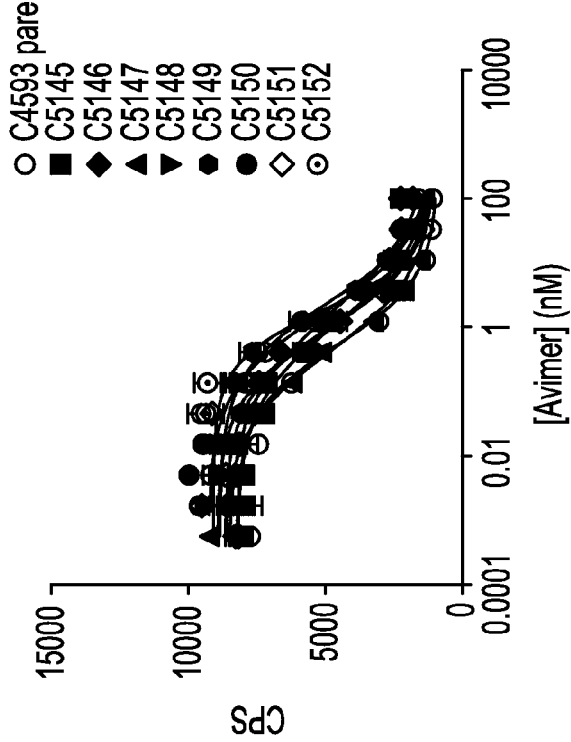
Figure 18D:
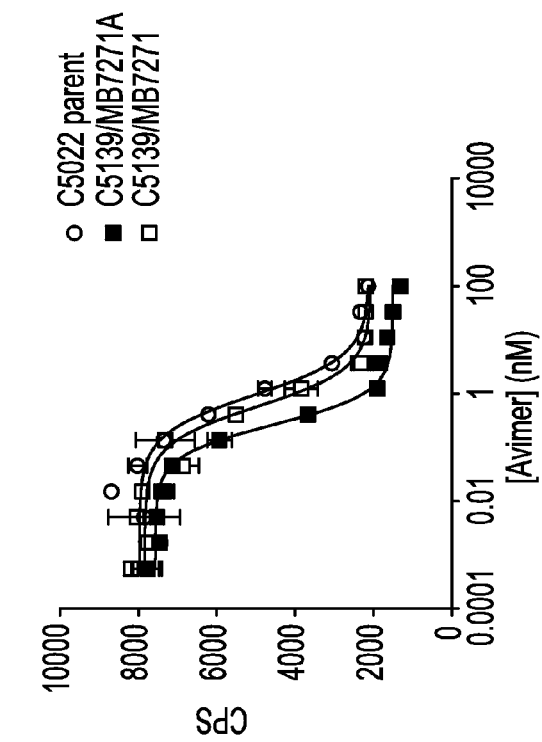
Figure 18C:
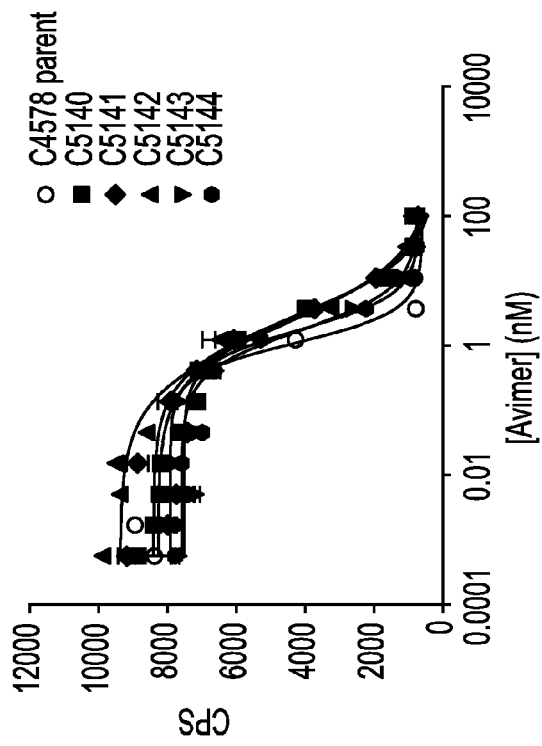

The original Avimer-antibody fusions exhibited a decreased "intact" PK exposure in rats, suggesting that the Avimer component was potentially being clipped. If this occurred, it would decrease the ability to bind Sclerostin as seen in the "intact" PK ELISA. Additionally, all seven Avimer-antibody fusions had O-linked glycosylation. To address both the potential clipping issue as well as the undesirable glycosylation, a three round approach was performed. First, in round 1 five Avimers were selected from the top 7 Avimer-antibody fusions as clones to focus the re-engineering process on. These clones were singly mutated at all lysine and arginine residues as well as at Serine and Threonine residues that were O-glycosylated. Some Avimer linkers were replaced with Glycine or Glycine/Serine linkers. A total of 27 different point mutants and linker mutants were created (Table 11). When tested in AlphaScreen inhibition, all 27 round 1 re-engineered mutants were able to neutralize Sclerostin and most had little to no change in potency when compared to the parental Avimers (FIG. 17).

Round 2 Re-engineered Sclerostin Neutralizing Avimers

In round 2, the tolerated mutations from round 1 were combined in different combinations into 21 different clones (Table 12). When tested by AlphaScreen inhibition, all 21 clones neutralized Sclerostin. The combination of mutations tended to either improve or reduce inhibitory potency. Some combinations had up to a 5-fold improvement in inhibition potency while others had up to a 30-fold loss of inhibition potency (FIG. 18).

Round 3 Re-engineered Sclerostin Neutralizing Avimers

Figure 19B:
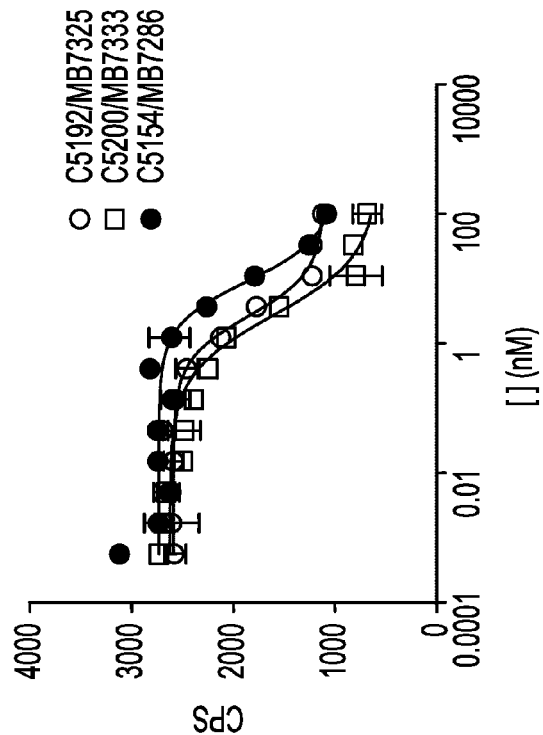
FIG. 19: Round 3 Re-engineered Avimers neutralize Sclerostin in AlphaScreen assays.
Figure 19A:
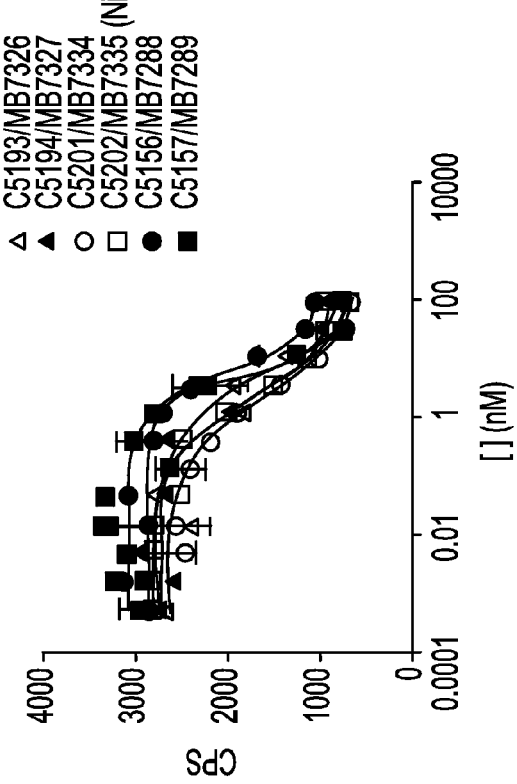

In round 3, two Avimers had their linkers mutated either with replacing threonine with alanine or replacing the entire linkers with Glycine and Alanine The best round 2 re-engineered mutants were modified at the C-terminus either with a Glycinex4 linker or with removing the C-terminal linker. 24 new clones were constructed (Table 13). When tested by AlphaScreen inhibition, all 24 round 3 clones neutralized Sclerostin. When compared to parental clones, most changes had only minor (<=2-fold) effects on potency (FIG. 19).

TABLE 11

Round 1 re-engineered Sclerostin-neutralizing Avimers amino acid sequences

| Avimer | Avimer amino acid residues |
|---|---|
| C5056 | CPAYTEFLCADSDRCFPSEWRCDGEMDCVDGSDELHCAYHTCAPNQFRCNSYDKCVPAHWVCDGVLDCLDSSDETNCSAPASEPPGSL |
| C5057 | CPAYTEFLCKDSDACFPSEWRCDGEMDCVDGSDELHCAYHTCAPNQFRCNSYDKCVPAHWVCDGVLDCLDSSDETNCSAPASEPPGSL |
| C5058 | CPAYTEFLCKDSDRCFPSEWACDGEMDCVDGSDELHCAYHTCAPNQFRCNSYDKCVPAHWVCDGVLDCLDSSDETNCSAPASEPPGSL |
| C5059 | CPAYTEFLCKDSDRCFPSEWRCDGEMECVDGSDELHCAYHTCAPNQFRCNSYDKCVPAHWVCDGVLDCLDSSDETNCSAPASEPPGSL |
| C5060 | CPAYTEFLCKDSDRCFPSEWRCDGEMDCVDGSDELHCAYHACAPNQFRCNSYDKCVPAHWVCDGVLDCLDSSDETNCSAPASEPPGSL |
| C5061 | CPAYTEFLCKDSDRCFPSEWRCDGEMDCVDGSDELHCAYHTCAPNQFACNSYDKCVPAHWVCDGVLDCLDSSDETNCSAPASEPPGSL |
| C5062 | CPAYTEFLCKDSDRCFPSEWRCDGEMDCVDGSDELHCAYHTCAPNQFLCNSYDKCVPAHWVCDGVLDCLDSSDETNCSAPASEPPGSL |
| C5063 | CPAYTEFLCKDSDRCFPSEWRCDGEMDCVDGSDELHCAYHTCAPNQFRCNSYDACVPAHWVCDGVLDCLDSSDETNCSAPASEPPGSL |
| C5064 | CPAYTEFLCKDSDRCFPSEWRCDGEMDCVDGSDELHCAYHTCAPNQFRCNSYDKCVPAHWVCDGVLDCLDSSDETNCSAPAAEPPGSL |
| C5065 | CPAYTEFLCKDSDRCFPSEWRCDGEMDCVDGSDELHCGGGGCAPNQFRCNSYDKCVPAHWVCDGVLDCLDSSDETNCSAPASEPPGSL |
| C5066 | CPAYTEFLCKDSDRCFPSEWRCDGEMDCVDGSDELHCAYHTCAPNQFRCNSYDKCVPAHWVCDGVLDCLDSSDETNCGGGGSGGGGS |
| C5067 | CAPNQFRCNSYDACVPAHWVCDGVLDCLDSSDETNCSAPASEPPGSLCPAYTEFLCKDSDRCFPSEWRCDGEMDCVDGSDELHCAYHT |
| C5068 | CAPNQFRCNSYDKCVPAHWVCDGVLDCLDSSDETNCSAPAAEPPGSLCPAYTEFLCKDSDRCFPSEWRCDGEMDCVDGSDELHCAYHT |
| C5069 | CAPNQFRCNSYDKCVPAHWVCDGVLDCLDSSDETNCGGGGSGGGGSCPAYTEFLCKDSDRCFPSEWRCDGEMDCVDGSDELHCAYHT |
| C5070 | CAPNQFRCNSYDKCVPAHWVCDGVLDCLDSSDETNCSAPASEPPGSLCPAYTEFLCADSDRCFPSEWRCDGEMDCVDGSDELHCAYHT |
| C5071 | CAPNQFRCNSYDKCVPAHWVCDGVLDCLDSSDETNCSAPASEPPGSLCPAYTEFLCKDSDACFPSEWRCDGEMDCVDGSDELHCAYHT |
| C5072 | CAPNQFRCNSYDKCVPAHWVCDGVLDCLDSSDETNCSAPASEPPGSLCPAYTEFLCKDSDRCFPSEWACDGEMDCVDGSDELHCAYHT |
| C5073 | CAPNQFRCNSYDKCVPAHWVCDGVLDCLDSSDETNCSAPASEPPGSLCPAYTEFLCKDSDRCFPSEWRCDGEMDCVDGSDELHCAYHA |
| C5074 | CAPNQFRCNSYDKCVPAHWVCDGVLDCLDSSDETNCSAPASEPPGSLCPAYTEFLCKDSDRCFPSEWRCDGEMDCVDGSDELHCGGGG |
| C5075 | CPAGQFTCGNGHCIPLPWLCDGANDCGDGSDEAPQCETAAPTCGSAEFPCQGPDICLPPEWICDGDDDCLETSDEAYCSQDPEFHKV |
| C5076 | CPAGQFTCGNGHCIPLPWLCDGANDCGDGSDEAPQCETAAPTCGSYEFPCQGPDICLPPEWICDGDDDCLETSDEAYCSQDPEFHKV |
| C5077 | CPAGQFTCGNGHCIPLPWLCDGANDCGDGSDEAPQCETAAPTCGSREFPCQGPDICLPPEWICDGDDDCLETSDEAYCSQDPEFHAV |
| C5078 | CPAGQFTCGNGHCIPLPWLCDGANDCGDGSDEAPQCETAAPTCGSREFPCQGPDICLPPEWICDGDDDCLETSDEAYCGGGGSGGGGS |
| C5079 | CPSGQFTCGNGYCIPEEWVCDGVDDCGDGSDEPPLCETAVPTCGSAEFPCQGTDICLPPEWICDGDDDCLDTPDEAYCSQDPEFHKV |
| C5080 | CPSGQFTCGNGYCIPEEWVCDGVDDCGDGSDEPPLCETAVPTCGSYEFPCQGTDICLPPEWICDGDDDCLDTPDEAYCSQDPEFHKV |

TABLE 11-continued

Round 1 re-engineered Sclerostin-neutralizing Avimers amino acid sequences

| Avimer | Avimer amino acid residues |
|---|---|
| C5081 | CPSGQFTCGNGYCIPEEWVCDGVDDCGDGSDEPPLCETAVPTCGSREFPCQGTDICLPPEWICDGDDDCLDTPDEAYCSQDPEFHAV |
| C5082 | CPSGQFTCGNGYCIPEEWVCDGVDDCGDGSDEPPLCETAVPTCGSREFPCQGTDICLPPEWICDGDDDCLDTPDEAYCGGGGSGGGGS |

TABLE 12

Round 2 Re-engineered Sclerostin neutralizing Avimers

| Avimer | Avimer amino acid sequence |
|---|---|
| C5138 | CPAGQFTCGNGHCIPLPWLCDGANDCGDGSDEAPQCETAAPTCGSAEFPCQGPDICLPPEWICDGDDDCLETSDEAYCGGGGSGGGGS |
| C5139 | CPSGQFTCGNGYCIPEEWVCDGVDDCGDGSDEPPLCETAVPTCGSAEFPCQGTDICLPPEWICDGDDDCLDTPDEAYCGGGGSGGGGS |
| C5140 | CPAYTEFLCADSDACFPSEWACDGEMDCVDGSDELHCGGGGCAPNQFACNSYDACVPAHWVCDGVLDCLDSSDETNCGGGGSGGGGS |
| C5141 | CPAYTEFLCADSDACFPSEWACDGEMDCVDGSDELHCGGGGCAPNQFACNSYDKCVPAHWVCDGVLDCLDSSDETNCGGGGSGGGGS |
| C5142 | CPAYTEFLCADSDACFPSEWRCDGEMDCVDGSDELHCGGGGCAPNQFACNSYDKCVPAHWVCDGVLDCLDSSDETNCGGGGSGGGGS |
| C5143 | CPAYTEFLCADSDACFPSEWRCDGEMDCVDGSDELHCGGGGCAPNQFACNSYDACVPAHWVCDGVLDCLDSSDETNCGGGGSGGGGS |
| C5144 | CPAYTEFLCADSDACFPSEWRCDGEMDCVDGSDELHCGGGGCAPNQFRCNSYDKCVPAHWVCDGVLDCLDSSDETNCGGGGSGGGGS |
| C5145 | CAPNQFRCNSYDKCVPAHWVCDGVLDCLDSSDETNCGGGGSGGGGSCPAYTEFLCADSDACFPSEWACDGEMDCVDGSDELHCGGGG |
| C5146 | CAPNQFRCNSYDKCVPAHWVCDGVLDCLDSSDETNCGGGGSGGGGSCPAYTEFLCKDSDACFPSEWACDGEMDCVDGSDELHCGGGG |
| C5147 | CAPNQFRCNSYDKCVPAHWVCDGVLDCLDSSDETNCGGGGSGGGGSCPAYTEFLCADSDRCFPSEWACDGEMDCVDGSDELHCGGGG |
| C5148 | CAPNQFRCNSYDKCVPAHWVCDGVLDCLDSSDETNCGGGGSGGGGSCPAYTEFLCADSDACFPSEWRCDGEMDCVDGSDELHCGGGG |
| C5149 | CAPNQFACNSYDKCVPAHWVCDGVLDCLDSSDETNCGGGGSGGGGSCPAYTEFLCADSDACFPSEWACDGEMDCVDGSDELHCGGGG |
| C5150 | CAPNQFACNSYDKCVPAHWVCDGVLDCLDSSDETNCGGGGSGGGGSCPAYTEFLCKDSDACFPSEWACDGEMDCVDGSDELHCGGGG |
| C5151 | CAPNQFACNSYDKCVPAHWVCDGVLDCLDSSDETNCGGGGSGGGGSCPAYTEFLCADSDRCFPSEWACDGEMDCVDGSDELHCGGGG |
| C5152 | CAPNQFACNSYDKCVPAHWVCDGVLDCLDSSDETNCGGGGSGGGGSCPAYTEFLCADSDACFPSEWRCDGEMDCVDGSDELHCGGGG |
| C5153 | WCPPNHFMCNSYDKCVPAHWFCDGVLDCLDSSDETNCGGGGSGGGGSCPAYTEFLCADSDACFPSEWACDGEMDCVDGSDELHCGGGG |
| C5154 | CPPNHFMCNSYDKCVPAHWFCDGVLDCLDSSDETNCGGGGSGGGGSCPAYTEFLCADSDACFPSEWACDGEMDCVDGSDELHCGGGG |
| C5155 | CPPNHFMCNSYDKCVPAHWFCDGVLDCLDSSDETNCSAPASEPPGSLCPAYTEFLCKDSDRCFPSEWRCDGEMDCVDGSDELHCAYHT |
| C5156 | CGADHFACASYDKCVPAHWLCDGVLDCLDSSDETYCGGGGSGGGGSCPAYTEFLCADSDACFPSEWACDGEMDCVDGSDELHCGGGG |
| C5157 | CGADHFRCASYDKCVPAHWLCDGVLDCLDSSDETYCGGGGSGGGGSCPAYTEFLCADSDACFPSEWACDGEMDCVDGSDELHCGGGG |

TABLE 12-continued

Round 2 Re-engineered Sclerostin neutralizing Avimers

| Avimer | Avimer amino acid sequence |
|---|---|
| C5158 | CGADHFACRSYDKCVPAHWLCDGVLDCLDSSDETYCGGGGSGGGGSCPAYTEFLCADSDACFPSEWACDGEMD CVDGSDELHCGGGG |

TABLE 13

Round 3 Re-engineered Sclerostin neutralizing Avimers

| Avimer | Avimer amino acid sequence |
|---|---|
| C5179 | CPAGQFTCGNGHCIPLPWLCDGANDCGDGSDEAPQCEAAAPACGSAEFPCQGPDICLPPEWICDGDDDCLETSDEAY CGGGG |
| C5180 | CPAGQFTCGNGHCIPLPWLCDGANDCGDGSDEAPQCGGGGAGCGSAEFPCQGPDICLPPEWICDGDDDCLETSDEA YCGGGG |
| C5181 | CPAGQFTCGNGHCIPLPWLCDGANDCGDGSDEAPQCEAAAPACGSAEFPCQGPDICLPPEWICDGDDDCLETSDEAYC |
| C5182 | CPAGQFTCGNGHCIPLPWLCDGANDCGDGSDEAPQCGGGGAGCGSAEFPCQGPDICLPPEWICDGDDDCLETSDEA YC |
| C5183 | CPSGQFTCGNGYCIPEEWVCDGVDDCGDGSDEPPLCEAAVPACGSAEFPCQGTDICLPPEWICDGDDDCLDTPDEAY CGGGG |
| C5184 | CPSGQFTCGNGYCIPEEWVCDGVDDCGDGSDEPPLCGGGGAGCGSAEFPCQGTDICLPPEWICDGDDDCLDTPDEAY CGGGG |
| C5185 | CPSGQFTCGNGYCIPEEWVCDGVDDCGDGSDEPPLCEAAVPACGSAEFPCQGTDICLPPEWICDGDDDCLDTPDEAYC |
| C5186 | CPSGQFTCGNGYCIPEEWVCDGVDDCGDGSDEPPLCGGGGAGCGSAEFPCQGTDICLPPEWICDGDDDCLDTPDEAYC |
| C5187 | CPAYTEFLCADSDACFPSEWACDGEMDCVDGSDELHCGGGGCAPNQFACNSYDACVPAHWVCDGVLDCLDSSDETN CGGGG |
| C5188 | CPAYTEFLCADSDACFPSEWRCDGEMDCVDGSDELHCGGGGCAPNQFACNSYDKCVPAHWVCDGVLDCLDSSDETN CGGGG |
| C5189 | CAPNQFRCNSYDKCVPAHWVCDGVLDCLDSSDETNCGGGGSGGGGSCPAYTEFLCADSDRCFPSEWACDGEMDCV DGSDELHCGGGG |
| C5190 | CAPNQFACNSYDKCVPAHWVCDGVLDCLDSSDETNCGGGGSGGGGSCPAYTEFLCADSDACFPSEWACDGEMDCV DGSDELHCGGGG |
| C5191 | CAPNQFACNSYDKCVPAHWVCDGVLDCLDSSDETNCGGGGSGGGGSCPAYTEFLCADSDRCFPSEWACDGEMDCV DGSDELHCGGGG |
| C5192 | CPPNHFMCNSYDKCVPAHWFCDGVLDCLDSSDETNCGGGGSGGGGSCPAYTEFLCADSDACFPSEWACDGEMDCV DGSDELHCGGGG |
| C5193 | CGADHFACASYDKCVPAHWLCDGVLDCLDSSDETYCGGGGSGGGGSCPAYTEFLCADSDACFPSEWACDGEMDCVD GSDELHCGGGG |
| C5194 | CGADHFRCASYDKCVPAHWLCDGVLDCLDSSDETYCGGGGSGGGGSCPAYTEFLCADSDACFPSEWACDGEMDCV DGSDELHCGGGG |
| C5195 | CPAYTEFLCADSDACFPSEWACDGEMDCVDGSDELHCGGGGCAPNQFACNSYDACVPAHWVCDGVLDCLDSSDETNC |
| C5196 | CPAYTEFLCADSDACFPSEWRCDGEMDCVDGSDELHCGGGGCAPNQFACNSYDKCVPAHWVCDGVLDCLDSSDETNC |
| C5197 | CAPNQFRCNSYDKCVPAHWVCDGVLDCLDSSDETNCGGGGSGGGGSCPAYTEFLCADSDRCFPSEWACDGEMDCV DGSDELHC |
| C5198 | CAPNQFACNSYDKCVPAHWVCDGVLDCLDSSDETNCGGGGSGGGGSCPAYTEFLCADSDACFPSEWACDGEMDCV DGSDELHC |
| C5199 | CAPNQFACNSYDKCVPAHWVCDGVLDCLDSSDETNCGGGGSGGGGSCPAYTEFLCADSDRCFPSEWACDGEMDCV DGSDELHC |
| C5200 | CPPNHFMCNSYDKCVPAHWFCDGVLDCLDSSDETNCGGGGSGGGGSCPAYTEFLCADSDACFPSEWACDGEMDCV DGSDELHC |
| C5201 | CGADHFACASYDKCVPAHWLCDGVLDCLDSSDETYCGGGGSGGGGSCPAYTEFLCADSDACFPSEWACDGEMDCVD GSDELHC |

TABLE 13-continued

Round 3 Re-engineered Sclerostin neutralizing Avimers

| Avimer | Avimer amino acid sequence |
|---|---|
| C5202 | CGADHFRCASYDKCVPAHWLCDGVLDCLDSSDETYCGGGGSGGGGSCPAYTEFLCADSDACFPSEWACDGEMDCVDGSDELHC |

Re-engineered Avimer-antibody Fusions

Figure 20B:
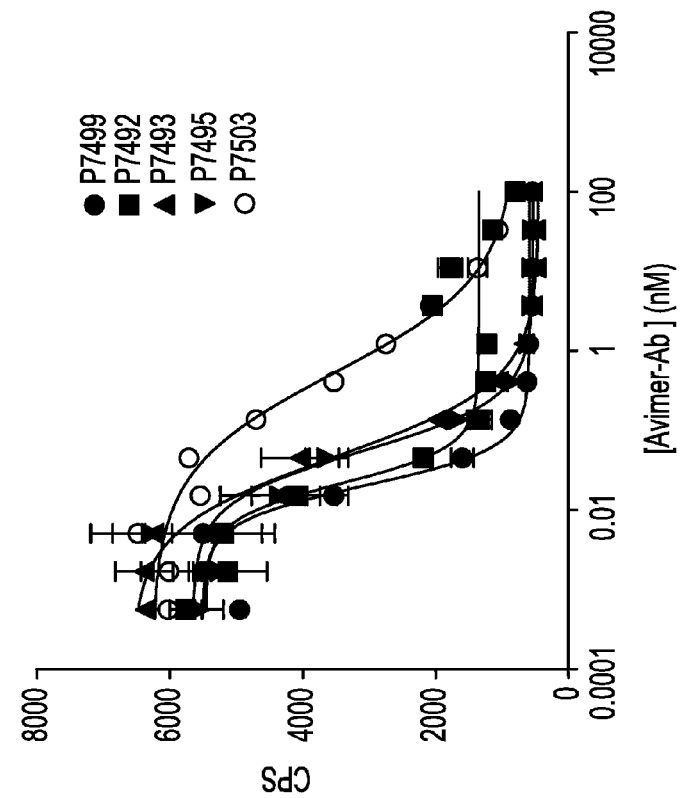
FIG. 20: Re-engineered Avimer-antibody fusions neutralize Sclerostin in AlphaScreen assays.
Figure 20A:
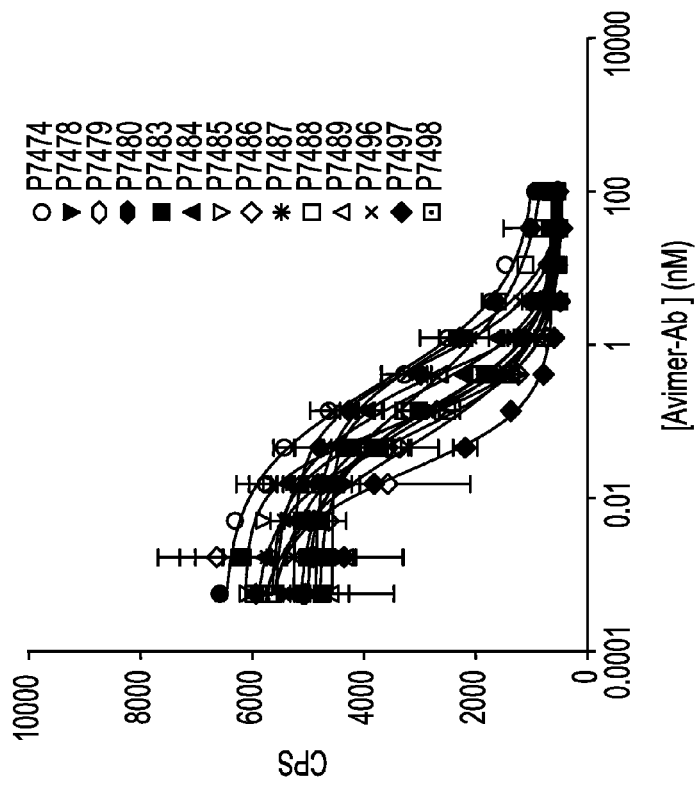

Ten of the most potent re-engineered Sclerostin neutralizing Avimers were fused to the 6.147.4 Dkk-1 blocking antibody. Since each re-engineered Sclerostin neutralizing Avimer is a modified version of an engineered Avimer that was used in the original Avimer-antibody fusions, the antibody fusion format used for the re-engineered Avimer-antibody fusions was the same as the corresponding original engineered Avimer-antibody fusion. This works out to 19 re-engineered Avimer-antibody fusions (Table 14). When tested in an AlphaScreen inhibition assay, the re-engineered Avimer-antibody fusions were very potent with eight of them having 20-90 pM IC50s. The remaining fusions neutralize Sclerostin between 100 and 850 pM (FIG. 20).

TABLE 14

Re-engineered Avimer-antibody fusions amino acid sequences

| Lot # | LMR C# | Full Avimer-antibody amino acid sequences |
|---|---|---|
| P7474 | C74277 | QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCGSYEFPCQGTDICLLPAWLCDGDADCRYYSDETDCSQDPEFHAV |
| P7503 | C74156 | QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCGSYEFPCQGTDICLLPAWLCDGDADCRYYSDETDCSQDPEFHAVGPP |
| P7483 | C74603 | QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCPAGQFTCGNGHCIPLPWLCDGANDCGDGSDEAPQCGGGGAGCGSAEFPCQGPDICLPPEWICDGDDDCLETSDEAYC |
| P7488 | C74609 | YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGGGGAGCPAGQFTCGNGHCIPLPWLCDGANDCGDGSDEAPQCGGGGAGCGSAEFPCQGPDICLPPEWICDGDDDCLETSDEAYC |
| P7484 | C74604 | QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCPSGQFTCGNGYCIPEEWVCDGVDDCGDGSDEPPLCEAAVPACGSAEFPCQGTDICLPPEWICDGDDDCLDTPDEAYC |
| P7489 | C74610 | YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGGGGAGCPSGQFTCGNGYCIPEEWVCDGVDDCGDGSDEPPLCEAAVPACGSAEFPCQGTDICLPPEWICDGDDDCLDTPDEAYC |
| P7478 | C74283 | YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCADSDACFPSEWRCDGEMDCVDGSDELHCGGGGCAPNQFACNSYDKCVPAHWVCDGVLDCLDSSDETNCGGGG |

TABLE 14-continued

Re-engineered Avimer-antibody fusions amino acid sequences

Lot # LMR C# Full Avimer-antibody amino acid sequences

P7479 C74284 YVLTQPPSVSVAPGQTARITCGGNNIGSKSVHWYQQKPGQAPVLVVYDDSDRPSEIPERFSGSNSGNTA
TLTISRVEAGDEADYYCQVWDSSSDHVVFGGGTRLTVLGQPKAAPSVTLFPPSSEELQANKATLVCLIS
DFYPGAVTVAWKADSSPVKAGVETTTPSKQSNNKYAASSYLSLTPEQWKSHRSYSCQVTHEGSTVEKT
VAPTECSSSGGSCPAYTEFLCADSDACFPSEWACDGEMDCVDGSDELHCGGGGCAPNQFACNSYDAC
VPAHWVCDGVLDCLDSSDETNC

P7497 C74621 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR
WQQGNVFSCSVMHEALHNHYTQKSLSLSPGSSGGSCPAYTEFLCADSDACFPSEWACDGEMDCVDGS
DELHCGGGGCAPNQFACNSYDACVPAHWVCDGVLDCLDSSDETNC

P7499 C74707 SSGGSCPAYTEFLCADSDACFPSEWACDGEMDCVDGSDELHCGGGGCAPNQFACNSYDACVPAHWVC
DGVLDCLDSSDETNCGGGGSGGGGSQVQLVESGGGVVQPGRSLRLSCAASGFTFSRYDMHWVRQAPG
KGLEWVAIIFYDGSNKYYADPVKGRFTISRDNSKNTLYLQMNSLRAEDTAVYYCATLAAAFDYWGQG
TLVTVSSASTKGPSVFPLAPCSRSTSESTAALGCLVKDYFPEPVTVSWNSGALTSGVHTFPAVLQSSGLY
SLSSVVTVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKEYK
CKVSNKGLPAPIEKTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPG

P7493 C74565 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR
WQQGNVFSCSVMHEALHNHYTQKSLSLSPGSSGGSCPAYTEFLCADSDACFPSEWRCDGEMDCVDGS
DELHCGGGGCAPNQFACNSYDKCVPAHWVCDGVLDCLDSSDETNCGGGG

P7495 C74581 SSGGSCPAYTEFLCADSDACFPSEWRCDGEMDCVDGSDELHCGGGGCAPNQFACNSYDKCVPAHWVC
DGVLDCLDSSDETNCGGGGSGGGGSQVQLVESGGGVVQPGRSLRLSCAASGFTFSRYDMHWVRQAPG
KGLEWVAIIFYDGSNKYYADPVKGRFTISRDNSKNTLYLQMNSLRAEDTAVYYCATLAAAFDYWGQG
TLVTVSSASTKGPSVFPLAPCSRSTSESTAALGCLVKDYFPEPVTVSWNSGALTSGVHTFPAVLQSSGLY
SLSSVVTVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKEYK
CKVSNKGLPAPIEKTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPG

P7485 C74605 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR
WQQGNVFSCSVMHEALHNHYTQKSLSLSPGGGGAGCAPNQFACNSYDKCVPAHWVCDGVLDCLDS
SDETNCGGGGSGGGGSCPAYTEFLCADSDACFPSEWACDGEMDCVDGSDELHCGGGG

P7486 C74606 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR
WQQGNVFSCSVMHEALHNHYTQKSLSLSPGGGGAGCAPNQFACNSYDKCVPAHWVCDGVLDCLDS
SDETNCGGGGSGGGGSCPAYTEFLCADSDRCFPSEWACDGEMDCVDGSDELHCGGGG

P7487 C74607 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR
WQQGNVFSCSVMHEALHNHYTQKSLSLSPGGGGAGCAPNQFRCNSYDKCVPAHWVCDGVLDCLDS
SDETNCGGGGSGGGGSCPAYTEFLCADSDRCFPSEWACDGEMDCVDGSDELHC

P7480 C74308 QVQLVESGGGVVQPGRSLRLSCAASGFTFSRYDMHWVRQAPGKGLEWVAIIFYDGSNKYYADPVKGR
FTISRDNSKNTLYLQMNSLRAEDTAVYYCATLAAAFDYWGQGTLVTVSSASTKGPSVFPLAPCSRSTSE
STAALGCLVKDYFPEPVTVSWNSGALTSGVHTFPAVLQSSGLYSLSSVVTVPSSNFGTQTYTCNVDHKP
SNTKVDKTVERKCCVECPPCPAPPVAGPSVFLFPPKPKDTLMISRTPEVTCVVVDVSHEDPEVQFNWYV
DGVEVHNAKTKPREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSFFLYSKLTVDKSR

TABLE 14-continued

Re-engineered Avimer-antibody fusions amino acid sequences

| Lot # | LMR C# | Full Avimer-antibody amino acid sequences |
|---|---|---|
| | | WQQGNVFSCSVMHEALHNHYTQKSLSLSPGSSGGSCGADHFRCASYDKCVPAHWLCDGVLDCLDSSD<br>ETYCGGGGSGGGGSCPAYTEFLCADSDACFPSEWACDGEMDCVDGSDELHCGGGG |
| P7496 | C74608 | QVQLVESGGGVVQPGRSLRLSCAASGFTFSRYDMHWVRQAPGKGLEWVAIIFYDGSNKYYADPVKGR<br>FTISRDNSKNTLYLQMNSLRAEDTAVYYCATLAAAFDYWGQGTLVTVSSASTKGPSVFPLAPCSRSTSE<br>STAALGCLVKDYFPEPVTVSWNSGALTSGVHTFPAVLQSSGLYSLSSVVTVPSSNFGTQTYTCNVDHKP<br>SNTKVDKTVERKCCVECPPCPAPPVAGPSVFLFPPKPKDTLMISRTPEVTCVVVDVSHEDPEVQFNWYV<br>DGVEVHNAKTKPREEQFNSTFRVVSVLTVVHQDWLNGKEYKCKVSNKGLPAPIEKTISKTKGQPREPQ<br>VYTLPPSREEMTKNQVSLTCLVKGFYPSDIAVEWESNGQPENNYKTTPPMLDSDGSFFLYSKLTVDKSR<br>WQQGNVFSCSVMHEALHNHYTQKSLSLSPGGGGGAGCGADHFACASYDKCVPAHWLCDGVLDCLDS<br>SDETYCGGGGSGGGGSCPAYTEFLCADSDACFPSEWACDGEMDCVDGSDELHC |
| P7498 | C74633 | QVQLVESGGGVVQPGRSLRLSCAASGFTFSRYDMHWVRQAPGKGLEWVAIIFYDGSNKYYADPVKGR<br>FTISRDNSKNTLYLQMNSLRAEDTAVYYCATLAAAFDYWGQGTLVTVSSASTKGPSVFPLAPCSRSTSE<br>STAALGCLVKDYFPEPVTVSWNSGALTSGVHTFPAVLQSSGLYSLSSVVTVPSSNFGTQTYTCNVDHKP<br>SNTKVDKTVERKCCVECPPCPAPPVAGPSVFLFPPKPKDTLMISRTPEVTCVVVDVSHEDPEVQFNWYV<br>DGVEVHNAKTKPREEQFNSTFRVVSVLTVVHQDWLNGKEYKCKVSNKGLPAPIEKTISKTKGQPREPQ<br>VYTLPPSREEMTKNQVSLTCLVKGFYPSDIAVEWESNGQPENNYKTTPPMLDSDGSFFLYSKLTVDKSR<br>WQQGNVFSCSVMHEALHNHYTQKSLSLSPGSSGGSCPPNHFMCNSYDKCVPAHWFCDGVLDCLDSSD<br>ETNCGGGGSGGGGSCPAYTEFLCADSDACFPSEWACDGEMDCVDGSDELHC |
| P7492 | C74518 | SSGGSCPPNHFMCNSYDKCVPAHWFCDGVLDCLDSSDETNCGGGGSGGGGSCPAYTEFLCADSDACFP<br>SEWACDGEMDCVDGSDELHCGGGGQVQLVESGGGVVQPGRSLRLSCAASGFTFSRYDMHWVRQAPG<br>KGLEWVAIIFYDGSNKYYADPVKGRFTISRDNSKNTLYLQMNSLRAEDTAVYYCATLAAAFDYWGQG<br>TLVTVSSASTKGPSVFPLAPCSRSTSESTAALGCLVKDYFPEPVTVSWNSGALTSGVHTFPAVLQSSGLY<br>SLSSVVTVPSSNFGTQTYTCNVDHKPSNTKVDKTVERKCCVECPPCPAPPVAGPSVFLFPPKPKDTLMIS<br>RTPEVTCVVVDVSHEDPEVQFNWYVDGVEVHNAKTKPREEQFNSTFRVVSVLTVVHQDWLNGKEYK<br>CKVSNKGLPAPIEKTISKTKGQPREPQVYTLPPSREEMTKNQVSLTCLVKGFYPSDIAVEWESNGQPENN<br>YKTTPPMLDSDGSFFLYSKLTVDKSRWQQGNVFSCSVMHEALHNHYTQKSLSLSPG |

Single Change Sclerostin Neutralizing Avimer-antibody Fusions

Figure 21A:
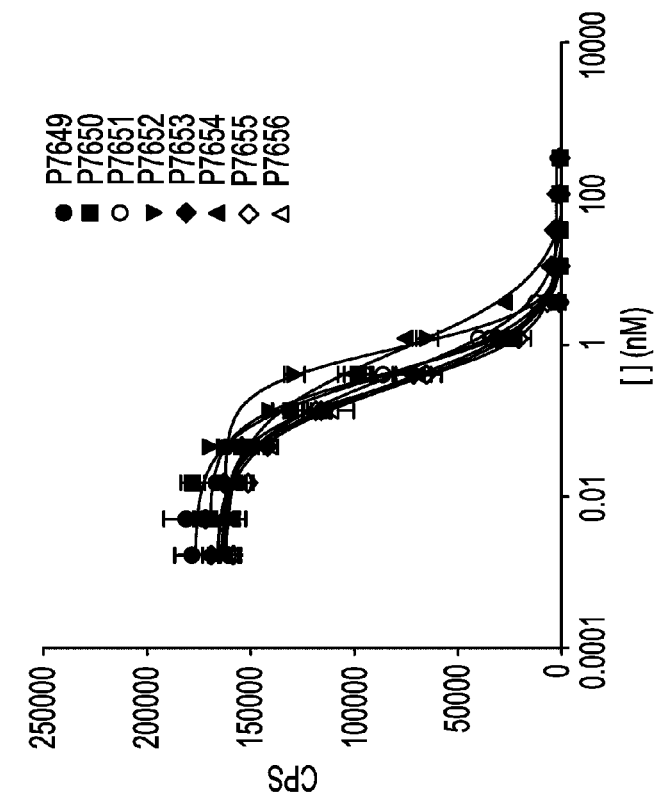
FIG. 21: Single change Avimer-antibody fusions neutralize both human and rat Sclerostin in AlphaScreen inhibition assays.
Figure 21B:
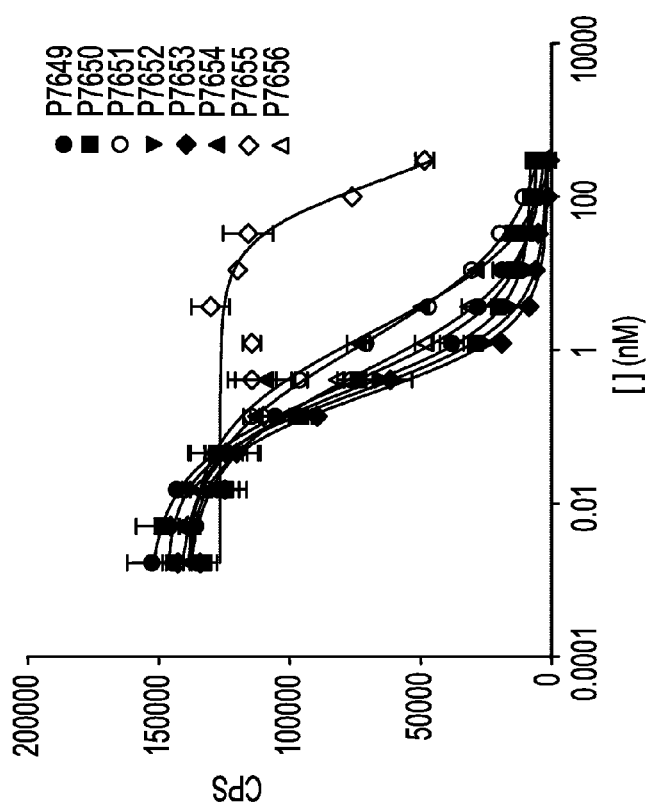

The engineered Avimers in the original Avimer-antibody fusions were modified with multiple changes in order to generate the re-engineered Avimer-antibodies. In order to understand the contribution each mutation makes in the characteristics of the re-engineered Avimer-antibody fusions, four individual mutations were made in a set of eight "single change" Avimer-antibody fusions. The four mutations are (1) removing the heavy chain-terminal lysine; (2) mutating an internal Avimer Lysine residue to alanine; (3) replacing the Avimer lysine and arginine residues to alanine and (4) replacing the Avimer linkers with glycine/serine linkers. Eight "single change" Avimer-antibody sequences are listed in Table 15. When the eight fusions are tested in an AlphaScreen inhibition assay, they neutralize both human and rat Sclerostin between 0.3 and 2.0 nM IC50, except P7655 which blocks human Sclerostin at 150 nM (FIG. 21).

TABLE 15

Single Change Avimer-antibody fusions amino acid sequences

| Lot | LMR C# | Single Change Avimer-antibody fusions amino acid sequences |
|---|---|---|
| P7649 | C140159 | QVQLVESGGGVVQPGRSLRLSCAASGFTFSRYDMHWVRQAPGKGLEWVAIIFYDGSNKYYADPVKGRFT<br>ISRDNSKNTLYLQMNSLRAEDTAVYYCATLAAAFDYWGQGTLVTVSSASTKGPSVFPLAPCSRSTSESTAA<br>LGCLVKDYFPEPVTVSWNSGALTSGVHTFPAVLQSSGLYSLSSVVTVPSSNFGTQTYTCNVDHKPSNTKVD<br>KTVERKCCVECPPCPAPPVAGPSVFLFPPKPKDTLMISRTPEVTCVVVDVSHEDPEVQFNWYVDGVEVHN<br>AKTKPREEQFNSTFRVVSVLTVVHQDWLNGKEYKCKVSNKGLPAPIEKTISKTKGQPREPQVYTLPPSREE<br>MTKNQVSLTCLVKGFYPSDIAVEWESNGQPENNYKTTPPMLDSDGSFFLYSKLTVDKSRWQQGNVFSCSV<br>MHEALHNHYTQKSLSLSPGSSGGSCAPNQFRCNSYDKCVPAHWVCDGVLDCLDSSDETNCSAPASEPPGS<br>LCPAYTEFLCKDSDRCFPSEWRCDGEMDCVDGSDELHCAYHTSLQ |
| P7650 | C140160 | QVQLVESGGGVVQPGRSLRLSCAASGFTFSRYDMHWVRQAPGKGLEWVAIIFYDGSNKYYADPVKGRFT<br>ISRDNSKNTLYLQMNSLRAEDTAVYYCATLAAAFDYWGQGTLVTVSSASTKGPSVFPLAPCSRSTSESTAA<br>LGCLVKDYFPEPVTVSWNSGALTSGVHTFPAVLQSSGLYSLSSVVTVPSSNFGTQTYTCNVDHKPSNTKVD<br>KTVERKCCVECPPCPAPPVAGPSVFLFPPKPKDTLMISRTPEVTCVVVDVSHEDPEVQFNWYVDGVEVHN<br>AKTKPREEQFNSTFRVVSVLTVVHQDWLNGKEYKCKVSNKGLPAPIEKTISKTKGQPREPQVYTLPPSREE<br>MTKNQVSLTCLVKGFYPSDIAVEWESNGQPENNYKTTPPMLDSDGSFFLYSKLTVDKSRWQQGNVFSCSV<br>MHEALHNHYTQKSLSLSPGSSGGSCGRDHFRCRSYDKCVPAHWLCDGVLDCLDSSDETYCSAPASEPPGS<br>LCPAYTEFLCKDSDRCFPSEWRCDGEMDCVDGSDELHCAYHTSLQ |
| P7651 | C140161 | QVQLVESGGGVVQPGRSLRLSCAASGFTFSRYDMHWVRQAPGKGLEWVAIIFYDGSNKYYADPVKGRFT<br>ISRDNSKNTLYLQMNSLRAEDTAVYYCATLAAAFDYWGQGTLVTVSSASTKGPSVFPLAPCSRSTSESTAA<br>LGCLVKDYFPEPVTVSWNSGALTSGVHTFPAVLQSSGLYSLSSVVTVPSSNFGTQTYTCNVDHKPSNTKVD<br>KTVERKCCVECPPCPAPPVAGPSVFLFPPKPKDTLMISRTPEVTCVVVDVSHEDPEVQFNWYVDGVEVHN |

TABLE 15-continued

Single Change Avimer-antibody fusions amino acid sequences

| Lot | LMR C# | Single Change Avimer-antibody fusions amino acid sequences |
|---|---|---|
| | | AKTKPREEQFNSTFRVVSVLTVVHQDWLNGKEYKCKVSNKGLPAPIEKTISKTKGQPREPQVYTLPPSREE MTKNQVSLTCLVKGFYPSDIAVEWESNGQPENNYKTTPPMLDSDGSFFLYSKLTVDKSRWQQGNVFSCSV MHEALHNHYTQKSLSLSPGKSSGGSCAPNQFRCNSYDKCVPAHWVCDGVLDCLDSSDETNCSAPASEPPG SLCPAYTEFLCADSDRCFPSEWRCDGEMDCVDGSDELHCAYHTSLQ |
| P7652 | C140162 | YVLTQPPSVSVAPGQTARITCGGNNIGSKSVHWYQQKPGQAPVLVVYDDSDRPSEIPERFSGSNSGNTATL TISRVEAGDEADYYCQVWDSSSDHVVFGGGTRLTVLGQPKAAPSVTLFPPSSEELQANKATLVCLISDFYP GAVTVAWKADSSPVKAGVETTTPSKQSNNKYAASSYLSLTPEQWKSHRSYSCQVTHEGSTVEKTVAPTEC SSSGGSCPAYTEFLCADSDRCFPSEWRCDGEMDCVDGSDELHCAYHTCAPNQFRCNSYDKCVPAHWVCD GVLDCLDSSDETNCSAPASEPPGSLSLQ |
| P7653 | C140163 | SGGSCPAYTEFLCADSDACFPSEWACDGEMDCVDGSDELHCAYHTCAPNQFACNSYDACVPAHWVCDG VLDCLDSSDETNCSAPASEPPGSLSQVQLVESGGGVVQPGRSLRLSCAASGFTFSRYDMHWVRQAPGKGL EWVAIIFYDGSNKYYADPVKGRFTISRDNSKNTLYLQMNSLRAEDTAVYYCATLAAAFDYWGQGTLVTV SSASTKGPSVFPLAPCSRSTSESTAALGCLVKDYFPEPVTVSWNSGALTSGVHTFPAVLQSSGLYSLSSVVT VPSSNFGTQTYTCNVDHKPSNTKVDKTVERKCCVECPPCPAPPVAGPSVFLFPPKPKDTLMISRTPEVTCVV VDVSHEDPEVQFNWYVDGVEVHNAKTKPREEQFNSTFRVVSVLTVVHQDWLNGKEYKCKVSNKGLPAPI EKTISKTKGQPREPQVYTLPPSREEMTKNQVSLTCLVKGFYPSDIAVEWESNGQPENNYKTTPPMLDSDGS FFLYSKLTVDKSRWQQGNVFSCSVMHEALHNHYTQKSLSLSPGK |
| P7654 | C140164 | QVQLVESGGGVVQPGRSLRLSCAASGFTFSRYDMHWVRQAPGKGLEWVAIIFYDGSNKYYADPVKGRFT ISRDNSKNTLYLQMNSLRAEDTAVYYCATLAAAFDYWGQGTLVTVSSASTKGPSVFPLAPCSRSTSESTAA LGCLVKDYFPEPVTVSWNSGALTSGVHTFPAVLQSSGLYSLSSVVTVPSSNFGTQTYTCNVDHKPSNTKVD KTVERKCCVECPPCPAPPVAGPSVFLFPPKPKDTLMISRTPEVTCVVVDVSHEDPEVQFNWYVDGVEVHN AKTKPREEQFNSTFRVVSVLTVVHQDWLNGKEYKCKVSNKGLPAPIEKTISKTKGQPREPQVYTLPPSREE MTKNQVSLTCLVKGFYPSDIAVEWESNGQPENNYKTTPPMLDSDGSFFLYSKLTVDKSRWQQGNVFSCSV MHEALHNHYTQKSLSLSPGKSSGGSCAPNQFACNSYDKCVPAHWVCDGVLDCLDSSDETNCSAPASEPPG SLCPAYTEFLCADSDACFPSEWACDGEMDCVDGSDELHCAYHTSLQ |
| P7655 | C140165 | SGGSCPAYTEFLCKDSDRCFPSEWRCDGEMDCVDGSDELHCGGGGCAPNQFRCNSYDKCVPAHWVCDG VLDCLDSSDETNCGGGGSGGGGSQVQLVESGGGVVQPGRSLRLSCAASGFTFSRYDMHWVRQAPGKGLE WVAIIFYDGSNKYYADPVKGRFTISRDNSKNTLYLQMNSLRAEDTAVYYCATLAAAFDYWGQGTLVTVS SASTKGPSVFPLAPCSRSTSESTAALGCLVKDYFPEPVTVSWNSGALTSGVHTFPAVLQSSGLYSLSSVVTV PSSNFGTQTYTCNVDHKPSNTKVDKTVERKCCVECPPCPAPPVAGPSVFLFPPKPKDTLMISRTPEVTCVVV DVSHEDPEVQFNWYVDGVEVHNAKTKPREEQFNSTFRVVSVLTVVHQDWLNGKEYKCKVSNKGLPAPIE KTISKTKGQPREPQVYTLPPSREEMTKNQVSLTCLVKGFYPSDIAVEWESNGQPENNYKTTPPMLDSDGSF FLYSKLTVDKSRWQQGNVFSCSVMHEALHNHYTQKSLSLSPGK |
| P7656 | C140166 | QVQLVESGGGVVQPGRSLRLSCAASGFTFSRYDMHWVRQAPGKGLEWVAIIFYDGSNKYYADPVKGRFT ISRDNSKNTLYLQMNSLRAEDTAVYYCATLAAAFDYWGQGTLVTVSSASTKGPSVFPLAPCSRSTSESTAA LGCLVKDYFPEPVTVSWNSGALTSGVHTFPAVLQSSGLYSLSSVVTVPSSNFGTQTYTCNVDHKPSNTKVD KTVERKCCVECPPCPAPPVAGPSVFLFPPKPKDTLMISRTPEVTCVVVDVSHEDPEVQFNWYVDGVEVHN AKTKPREEQFNSTFRVVSVLTVVHQDWLNGKEYKCKVSNKGLPAPIEKTISKTKGQPREPQVYTLPPSREE MTKNQVSLTCLVKGFYPSDIAVEWESNGQPENNYKTTPPMLDSDGSFFLYSKLTVDKSRWQQGNVFSCSV MHEALHNHYTQKSLSLSPGKSSGGSCAPNQFRCNSYDKCVPAHWVCDGVLDCLDSSDETNCGGGGSGGG GSCPAYTEFLCKDSDRCFPSEWRCDGEMDCVDGSDELHC |

Figure 22B:
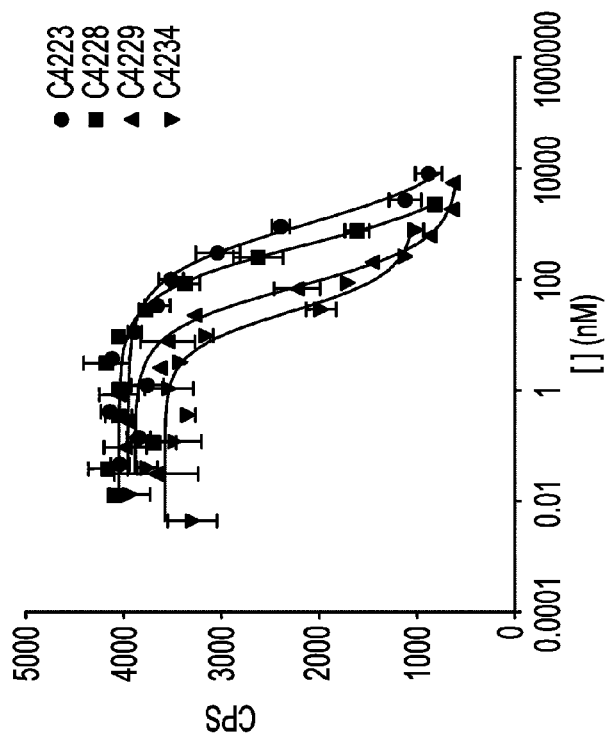
FIG. 22: Four naive Avimer monomers than block both human and rat Dkk-1 in AlphaScreen assays.
Figure 22A:
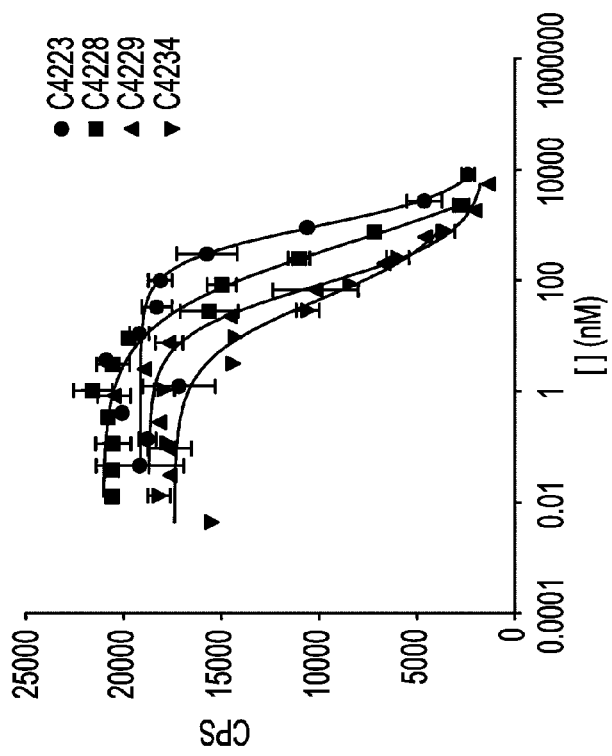

Dkk-1 Neutralizing Avimer Monomers; Dkk-1 Neutralizing Affinity Matured Monomers Naïve Avimer libraries were panned against human and rat Dkk-1 targets to select individual Avimer domains that preferentially bound to these targets. Screening was performed with AlphaScreen to then identify single clones that additionally blocked the Dkk-1/LRP6 interaction. Initially four naïve Avimer domains were identified that neutralize both human and rat Dkk-1 in AlphaScreen assays with in vitro IC50 potencies as good as 40 to 80 nM (Table 16 and FIG. 22).

Figure 23A:
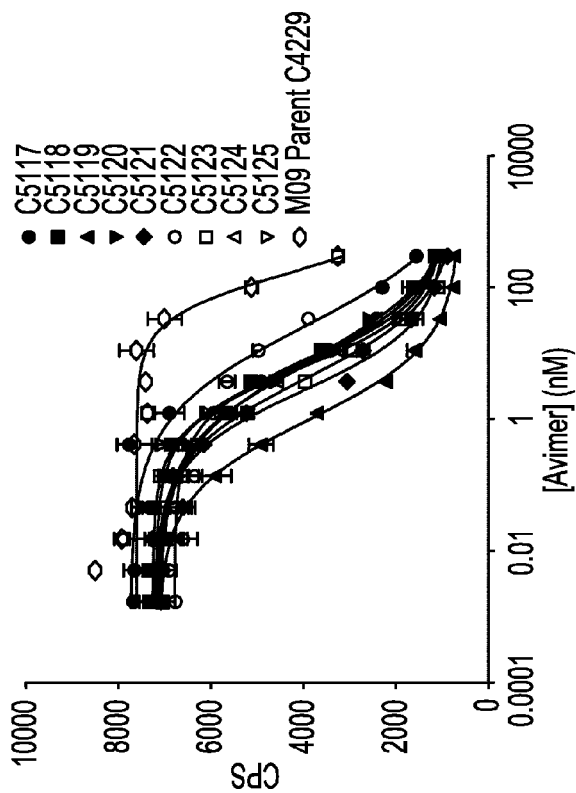
FIG. 23: Representative affinity matured Avimers neutralize both human and rat Dkk-1 in AlphaScreen assays.
Figure 23B:
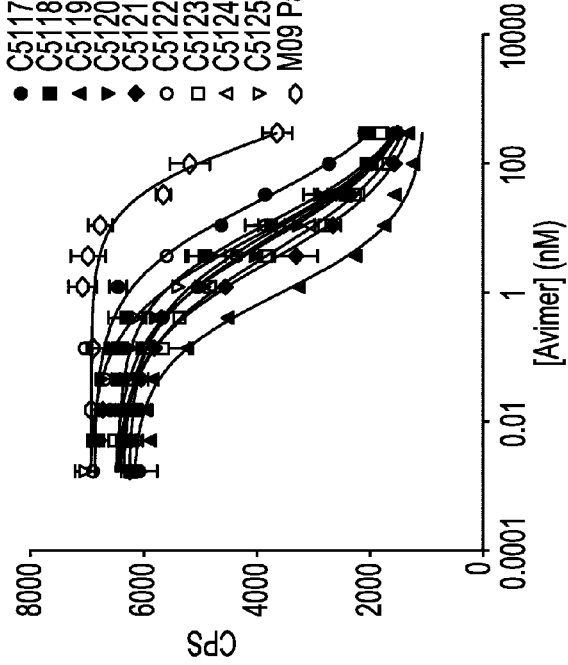
Figure 24A:
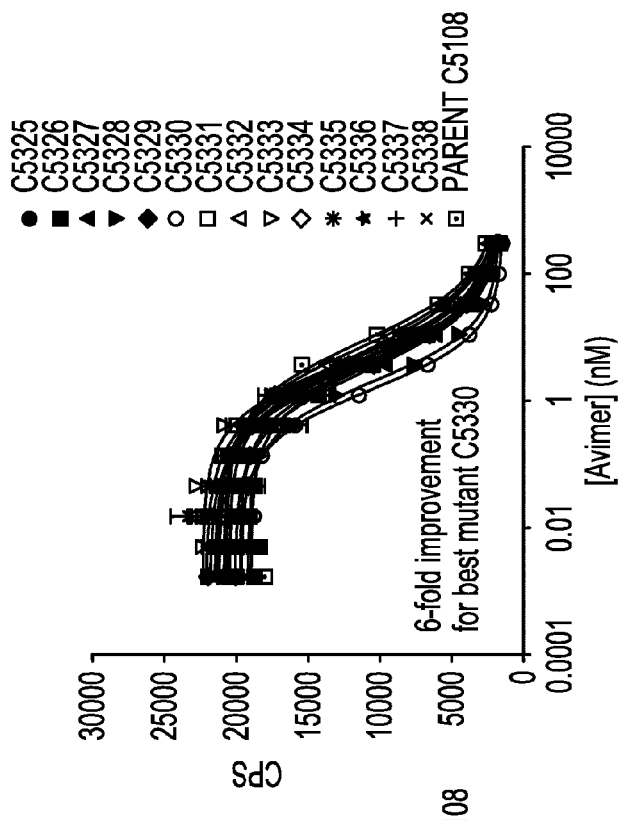
FIG. 24: Representative second round affinity matured Avimers neutralize both human and rat Dkk-1 in AlphaScreen assays.
Figure 24B:
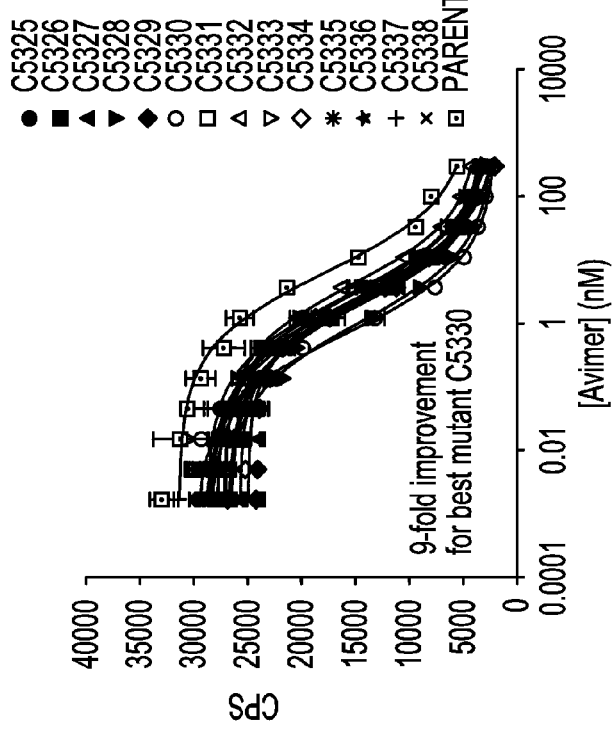

In order to improve the Dkk-1 neutralization activity of the Avimer monomers, C4229 and C4234 were affinity matured. A total of 35 different affinity matured Avimers were identified that neutralize Dkk-1 with potencies improved over 100-fold over the input monomers to IC50s as low as 1 nM (Table 17 and FIG. 23). In order to further improve Dkk-1 neutralizing activity, the affinity matured monomers C5130 and C5108 were affinity matured a second round to produce 25 new affinity matured monomers (Table 18). When tested in AlphaScreen inhibition assays, the twice-affinity matured Avimers were up to 6-9-fold more potent than the input singly-affinity matured Avimers (FIG. 24). When tested in the Wnt1 cell based assay, the twice-affinity matured Avimers neutralized human Dkk-1 with potencies between 0.8 and 3 nM IC50 (FIG. 25).

TABLE 16

Dkk-1 neutralizing Naïve Avimer monomer amino acid sequences

| Avimer | Dkk-1 neutralizing Avimer amino acid sequences |
|---|---|
| C4223 | CEAFGAFRCRSTGRCIPSEFVCDGDNDCDDGSDEPPFCPYRT |
| C4228 | CPAPIAFLCGDGTCIPKEWKCDGEWDCADGSDEAPATCPYRT |
| C4229 | CPASYFQCRNNNHCYPMEWRCDGFQDCEDGSDEKGCPYRT |
| C4234 | CPSNEFMCADKMCFPLIFLCDGENDCEDGSDEVDCPSRT |

TABLE 17

Affinity matured Dkk-1 neutralizing Avimer amino acids sequences

| Avimer | Amino acid sequences |
|---|---|
| C5102 | CPASYFKCRKHNHCYPMEWRCDGFQDCEDGSDEQACPYRT |
| C5103 | CPASYFKCRNYNHCYPMEWRCDGFRDCEDGSDEEGCPYRT |
| C5104 | CPASYFQCGNLNHCYPMEWRCDGFQDCVDGSDEKGCPYRT |
| C5105 | CPASYFQCGNYKHCYPMEWHCDGFQDCVDGSDEKACPYRT |
| C5106 | CPASYFQCGNYNHCYPMEWRCDGFLDCVDGSDEKGCPYRT |
| C5107 | CPASYFQCGNINHCYPVEWRCDGFQDCDDGSDEYVCPYRT |
| C5108 | CPASYFQCRNHPHCYPMEWRCDGFPDCVDGSDEKGCPYRT |
| C5109 | CPASYFQCGSHPHCYPMEWRCDGFQDCEDGSDELGCPYRT |
| C5110 | CPASYFQCLKHPHCYPMEWRCDGFDDCEDGSDETGCPYRT |
| C5111 | CPASYFQCMNHNHCYPMEWRCDGFPDCEDGSDEKGCPYRT |
| C5112 | CPASYFQCRHHNHCYPMEWRCDGFHDCVDGSDEIGCPYRT |
| C5113 | CPASYFQCRNNNSCYPMEWRCDGFEDCEDGSDERGCPYRT |
| C5114 | CPASYFQCRNYNHCYPMEWRCDGFEDCLDGSDETDCPYRT |
| C5115 | CPASYFQCWNFKHCYPMEWRCDGFNDCVDGSDEKGCPYRT |
| C5116 | CPASYFQCRHNKHCYPMEWRCDGFPDCEDGSDELSCPYRT |
| C5117 | CPASYFRCRNHNHCYPMEWRCDGFDDCEDGSDEQGCPYRT |
| C5118 | CPASYFRCRNRNHCYPMEWRCDGFPDCEDASDEKGCPYRT |
| C5119 | CPESYFQCREYKHCYPMEWRCDGFPDCVDGSDEDFCPYRT |
| C5120 | CPPSYFQCGNINHCYPMEWRCDGFHDCVDGSDEQGCPYRT |
| C5121 | CPVSYFKCRHRNHCYPMEWRCDGFPDCDDGSDERGCPYRT |
| C5122 | CPVSYFKCRNKNHCYPMEWRCDGFPDCEDGSDEKGCPYRT |
| C5123 | CPVSYFQCRIYNHCYPMEWRCDGFEDCVDGSDEKGCPYRT |
| C5124 | CPVSYFQCRYHNHCYPMEWRCDGFPDCEDASDEEGCPYRT |
| C5125 | CPVSYFRCRHLNHCYPMEWRCDGFLDCVDGSDEEGCPYRT |
| C5126 | CPLNEFMCPDKMCFPLIFLCDGENDCHDGSDEAYCPSRT |
| C5127 | CPQNEFMCADKTCFPPFSFLCDGDIDCYDGSDEAYCPSRT |
| C5128 | CPRNEFMCADKMCFPVSFLCDGENDCEDGSDEDYCPSRT |
| C5129 | CPSNEFMCADKICFPLSFLCDGENDCLDGSDEDYCPSRT |
| C5130 | CPSNEFMCADKVCFPWSFLCDGDNDCEDGSDELYCPSRT |
| C5131 | CPSNEFMCPDKICFPLSFLCDGENDCEDGSDEDYCPSRT |
| C5132 | CPSNEFMCPDKMCFPLSFLCDGENDCYDGSDEEDCPSRT |
| C5133 | CPSNEFMCPDKMCFPLSFRCDGENDCEDGSDELYCPSRT |
| C5134 | CPSYEFMCADKMCFPLDFLCDGENDCEDGSDEDYCPSRT |
| C5135 | CPSYEFMCADKMCFPLSFLCDGENDCEDGSDEDYCPSRT |
| C5136 | CPSYEFMCPDKVCFPLSFLCDGENDCQDGSDEDYCPSRT |

TABLE 18

Second round affinity matured Dkk-1 Avimers

| Avimer | Avimer amino acid sequence |
|---|---|
| C5318 | CPSNEFMCPDKVCFPWSFLCDGDNDCQDGSDEEYCGGGG |
| C5319 | CPSNEFMCPDKVCFPWSFLCDGDNDCEDGSDELFCGGGG |
| C5324 | CPSNEFMCADQVCFPWSFLCDGENDCEDGSDELYCGGGG |
| C5325 | CPAPYFQCRNDPPCHPMDWRCDGFPDCVDGSDEKGCGGGG |
| C5326 | CPASYFKCRNHPHCYPMEWRCDGFADCLDGSDESGCGGGG |
| C5327 | CPASYFKCRNHPHCYPMEWRCDGFADCVDGSDELSCGGGG |
| C5328 | CPASYFKCRNHPHCYPMEWRCDGFPDCIDGSDETACGGGG |
| C5329 | CPASYFKCRYHPHCYPMEWRCDGFSDCVDGSDEEACGGGG |
| C5330 | CPASYFQCGNLPHCYPMEWRCDGFPDCIDGSDEKGCGGGG |
| C5331 | CPASYFQCRKHPHCYPMEWRCDGFPDCIDGSDEERCGGGG |
| C5332 | CPASYFQCRNHPHCYPMEWRCDGFPDCLDGSDETDCGGGG |
| C5333 | CPASYFQCRNHPHCYPMEWRCDGFADCIDASDEIGCGGGG |
| C5334 | CPASYFQCRNHPHCYPMEWRCDGFEDCIDGSDEDNCGGGG |
| C5335 | CPASYFQCRNHPHCYPMEWRCDGFEDCIDGSDETSCGGGG |
| C5336 | CPASYFQCRNHPHCYPMEWRCDGFPDCIDGSDEESCGGGG |
| C5337 | CPASYFQCRNHPHCYPMEWRCDGFPDCIDGSDEQGCGGGG |
| C5338 | CPASYFQCRRHPHCYPMEWRCDGFPDCLDGSDEEGCGGGG |
| C5340 | CPASYFRCRNHPHCYPMEWRCDGFEDCVDGSDELDCGGGG |
| C5341 | CPATYFPCRNHPHCYPMEWRCDGFPDCIDESDEMGCGGGG |
| C5342 | CPESYFQCREYKHCYPMEWRCDGFPDCIDSSDETDCGGGG |
| C5343 | CPESYFQCRNHPHCYPMEWRCDGFEDCVDGSDELDCGGGG |
| C5344 | CPESYFQCRNHPHCYPMEWRCDGFPDCVDGSDELDCGGGG |
| C5345 | CPVSYFQCRNHPHCYPMEWRCDGFPDCIDGSDEEGCGGGG |
| C5346 | CPVSYFQCRNHPHCYPMEWRCDGFPDCLDESDEKGCGGGG |
| C5347 | CPVSYFQCRNHPHCYPMEWRCDGFPDCVDASDEIGCGGGG |

Dkk-1 Neutralizing Avimer Walked Dimers

Figure 26A:
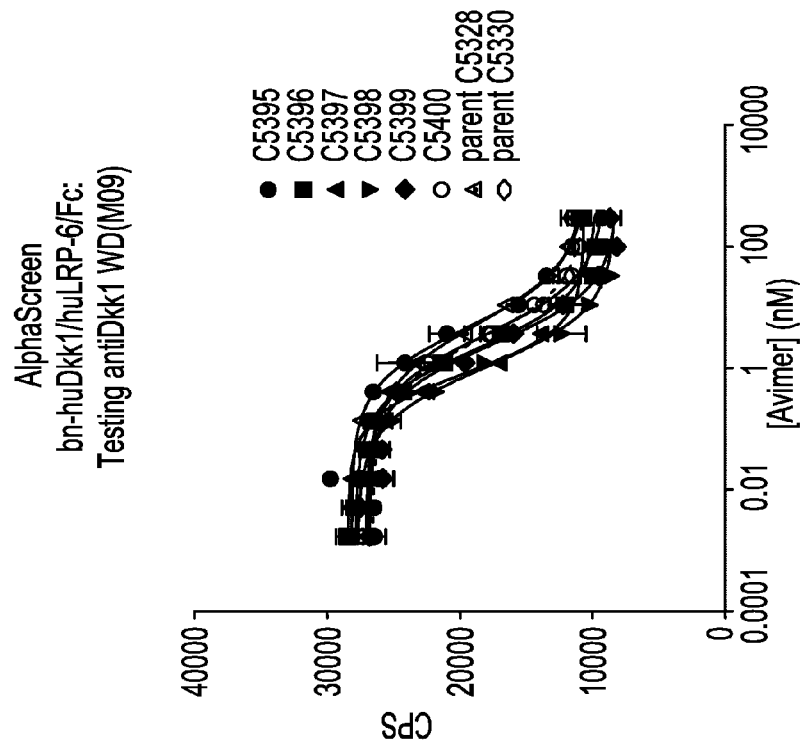
FIG. 26: Dkk-1 neutralizing Avimer walked dimers block Dkk-1 in AlphaScreen assays.
Figure 26B:
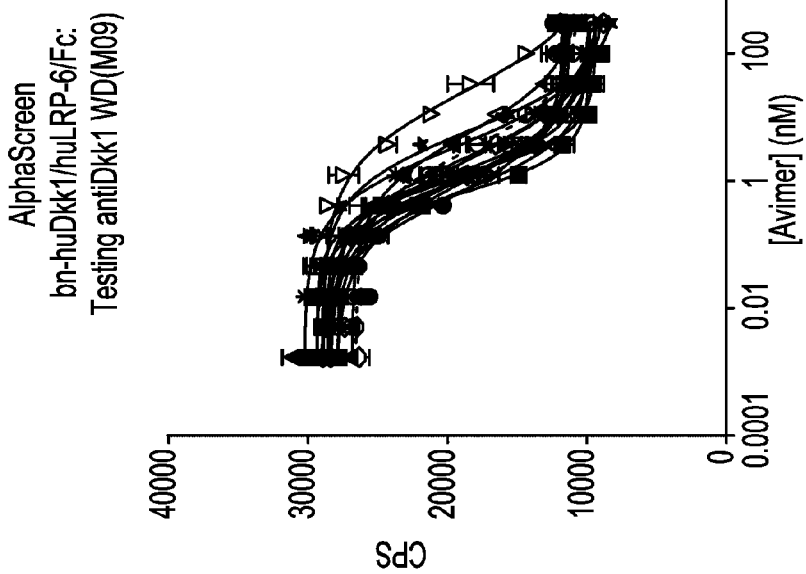

In order to improve Dkk-1 neutralizing activity of the Avimers, the best Avimer monomers were used as seeds and naïve Avimer libraries were fused to either the N- or C-terminus of these seeds to create Avimer walked dimers. These walked dimer libraries were selected for improved binding and inhibition activities. A total of 58 different Dkk-1 neutralizing Avimer walked dimers were identified (Table 19). Representative Alpha Screen inhibition assays show activities typically between 0.5 and 25 nM IC50 (FIG. 26). While these are potent activities and represent new Dkk-1 neutralizing Avimer sequences, they are only slightly improved compared to the monomer Avimer inputs (up to 2-3-fold).

TABLE 19

Dkk-1 neutralizing Avimer walked dimer amino acid sequences

| Avimer | Avimer amino acid sequence |
|---|---|
| C5348 | CRSNEFRCNNGHCIPADWVCDGEDDCEDNSDEANCGGGGCPASYFQCGNLPHCYPMEWRCDGFPDCIDGSDEKGCGGGG |
| C5349 | CHSPSEFECSSGNCIPAGWVCDGVDDCQDDSDESLDLCGGGGCPASYFQCGNLPHCYPMEWRCDGFPDCIDGSDEKGCGGGG |
| C5350 | CLSSEFPCKDSGKCVPRRLLCDGVDDCGDNSDEAGCGGGGCPASYFQCGNLPHCYPMEWRCDGFPDCIDGSDEKGCGGGG |
| C5351 | CESSDEFKCDSGNCIPLAWGCDGEDDCGDGSDEASCGGGGCPASYFQCGNLPHCYPMEWRCDGFPDCIDGSDEKGCGGGG |
| C5352 | CQSDEFRCSSGQCIPQHWLCDGENDCGDDSDESSAICGGGGCPASYFQCGNLPHCYPMEWRCDGFPDCIDGSDEKGCGGGG |
| C5353 | CVPSEFRCDNGQCIPLNWLCDGVNDCVDGSDETDCGGGGCPASYFQCGNLPHCYPMEWRCDGFPDCIDGSDEKGCGGGG |
| C5354 | CLSSQFRCGNGRCIPAHLLCDGVDDCQDDSDESPALCGGGGCPASYFQCGNLPHCYPMEWRCDGFPDCIDGSDEKGCGGGG |
| C5355 | CLAGQFPCSNGQCISAQWVCDGVPDCEDNSDESSEICGGGGCPASYFQCGNLPHCYPMEWRCDGFPDCIDGSDEKGCGGGG |
| C5356 | CQSNEFKCNNGKCIPASWVCDGVNDCGDNSDEAAVCGGGGCPASYFQCGNLPHCYPMEWRCDGFPDCIDGSDEKGCGGGG |
| C5357 | CQSNQFQCDNGNCIPVEWVCDGVNDCRDGSDESSELCGGGGCPASYFQCGNLPHCYPMEWRCDGFPDCIDGSDEKGCGGGG |
| C5358 | CQSDEFRCGSGNCLPPTLVCDGDDDCGDNSDETGCGGGGCPASYFQCGNLPHCYPMEWRCDGFPDCIDGSDEKGCGGGG |
| C5359 | CVASQFTCGNGNCLSPTWLCDGVNDCGDNSDETNCGGGGCPASYFQCGNLPHCYPMEWRCDGFPDCIDGSDEKGCGGGG |
| C5360 | CRANEFQCGNGQCVPQALLCDGVNDCGDGSDESSALCGGGGCPASYFQCGNLPHCYPMEWRCDGFPDCIDGSDEKGCGGGG |
| C5361 | CQSSQFRCNSGQCIPQGWVCDGENDCADSSDESPALCGGGGCPASYFQCGNLPHCYPMEWRCDGFPDCIDGSDEKGCGGGG |
| C5362 | CESSEFRCSNGRCIPAGWVCDGVNDCVDNSDESEQCGGGGCPASYFQCGNLPHCYPMEWRCDGFPDCIDGSDEKGCGGGG |
| C5363 | CQSNEFRCGSGHCIPLTLLCDGEDDCPDGSDESPEICGGGGCPASYFQCGNLPHCYPMEWRCDGFPDCIDGSDEKGCGGGG |
| C5364 | CPASQFRCNSGQCIPPHWVCDGVDDCGDGSDEASALCGGGGCPASYFQCGNLPHCYPMEWRCDGFPDCIDGSDEKGCGGGG |
| C5365 | CGAGEFPCDNGNCIPPQLVCDGEDDCGDGSDESQVCGGGGCPASYFQCGNLPHCYPMEWRCDGFPDCIDGSDEKGCGGGG |
| C5366 | CASGEFQCGSGNCIPQKWLCDGVNDCGDGSDESLDLCGGGGCPASYFQCGNLPHCYPMEWRCDGFPDCIDGSDEKGCGGGG |
| C5367 | CASNQFTCKSNGTCVPLHWVCDGENDCVDGSDEALENCGGGGCPASYFQCGNLPHCYPMEWRCDGFPDCIDGSDEKGCGGGG |
| C5368 | CGPSEFPCSNGSCIPPHLLCDGDDDCGDDSDEPLAPCGGGGCPASYFQCGNLPHCYPMEWRCDGFPDCIDGSDEKGCGGGG |
| C5369 | CQASEFKCDNGNCIPAGWVCDGVDDCGDGSDEAPATCGGGGCPASYFQCGNLPHCYPMEWRCDGFPDCIDGSDEKGCGGGG |
| C5370 | CGSSQFTCDNGNCISESWLCDGVNDCGDDSDESLAICGGGGCPASYFQCGNLPHCYPMEWRCDGFPDCIDGSDEKGCGGGG |
| C5371 | CAPDEFRCENGRCIPGEWRCDGNDCGDDSDETGCGGGGCPASYFQCGNLPHCYPMEWRCDGFPDCIDGSDEKGCGGGG |
| C5372 | CQPDEFRCNNGRCVPQPWHCDGDDDCEDNSDETDCGGGGCPASYFQCGNLPHCYPMEWRCDGFPDCIDGSDEKGCGGGG |

TABLE 19-continued

Dkk-1 neutralizing Avimer walked dimer amino acid sequences

| Avimer | Avimer amino acid sequence |
|---|---|
| C5373 | CASGEFPCNNGSCIPAAWRCDGDDDCGDGSDEASCGGGGCPASYFQCGNLPHCYPMEWRCDGFPDCIDGSDEKGCGGGG |
| C5374 | CQPSEFPCDNGSCVPEALVCDGEPDCVDNSDESAVCGGGGCPASYFQCGNLPHCYPMEWRCDGFPDCIDGSDEKGCGGGG |
| C5375 | CLSGEFRCKNGRCIPLDWRCDGDNDCGDNSDEAEVCGGGGCPASYFQCGNLPHCYPMEWRCDGFPDCIDGSDEKGCGGGG |
| C5376 | CEPSEFKCGNGKCIPGRWLCDGEDDCGDGSDEASEHCGGGGCPASYFQCGNLPHCYPMEWRCDGFPDCIDGSDEKGCGGGG |
| C5377 | CPPGEFTCSNGKCIPGHWVCDGENDCADNSDEAEVCGGGGCPASYFQCGNLPHCYPMEWRCDGFPDCIDGSDEKGCGGGG |
| C5378 | CESGEFKCSNGSCIPEEWRCDGENDCPDGSDEKSCGGGGCPASYFQCGNLPHCYPMEWRCDGFPDCIDGSDEKGCGGGG |
| C5379 | CPSGQFPCRNGKCIPQRWLCDGDDDCGDSSDEAPELCGGGGCPASYFQCGNLPHCYPMEWRCDGFPDCIDGSDEKGCGGGG |
| C5380 | CQADEFKCKNGRCIPAGWVCDGVNDCGDGSDEAPALCGGGGCPASYFQCGNLPHCYPMEWRCDGFPDCIDGSDEKGCGGGG |
| C5381 | CQASEFTCNNGQCIPAGWVCDGVNDCGDNSDEASALCGGGGCPASYFQCGNLPHCYPMEWRCDGFPDCIDGSDEKGCGGGG |
| C5382 | CRANEFKCRNGKCVSAGWVCDGVDDCGDNSDEAEVCGGGGCPASYFKCRNHPHCYPMEWRCDGFPDCIDGSDETACGGGG |
| C5383 | CPASYFQCGNLPHCYPMEWRCDGFPDCIDGSDEKGCGGGGCAPSEFRCGNGRCIPGELLCDGVNDCLDNSDEAADCGGGG |
| C5384 | CPASYFQCGNLPHCYPMEWRCDGFPDCIDGSDEKGCGGGGCVPGEFRCDNGQCIPPHWLCDGEPDCRDNSDESELCGGGG |
| C5385 | CPASYFQCGNLPHCYPMEWRCDGFPDCIDGSDEKGCGGGGCHPTDQFECGNGHCISGRWVCDGVNDCGDNSDETDCGGGG |
| C5386 | CPASYFQCGNLPHCYPMEWRCDGFPDCIDGSDEKGCGGGGCPPDQFQCNSGNCIPGDWRCDGDNDCGDGSDESELCGGGG |
| C5387 | CPASYFQCGNLPHCYPMEWRCDGFPDCIDGSDEKGCGGGGCPPSEFQCGNGQCVPAHWVCDGEPDCEDGSDEADCGGGG |
| C5388 | CPASYFQCGNLPHCYPMEWRCDGFPDCIDGSDEKGCGGGGCPSSEFQCGNGKCIPERWLCDGDNDCGDNSDESPECGGGG |
| C5389 | CPASYFKCRNHPHCYPMEWRCDGFPDCIDGSDETACGGGGCHPTDQFECKSGQCIPGALGCDGVNDCEDGSDESPDLCGGGG |
| C5390 | CPASYFQCGNLPHCYPMEWRCDGFPDCIDGSDEKGCGGGGCPPSEFPCGNGQCVPVPWLCDGDNDCVDDSDEEDCGGGG |
| C5391 | CPASYFQCGNLPHCYPMEWRCDGFPDCIDGSDEKGCGGGGCEPFDKFECGSGHCVPLDWVCDGEDDCPDDSDEPQQCGGGG |
| C5392 | CPASYFQCGNLPHCYPMEWRCDGFPDCIDGSDEKGCGGGGCPPNEFQCGNGHCIPENLLCDGVPDCEDGSDEAAQCGGGG |
| C5393 | CPASYFQCGNLPHCYPMEWRCDGFPDCIDGSDEKGCGGGGCDPFNQFECKNGKCIPAHWRCDGDDDCGDNSDGADCGGGG |
| C5394 | CPASYFQCGNLPHCYPMEWRCDGFPDCIDGSDEKGCGGGGCPSDQFTCRSGSCIPATWRCDGENDCGDNSDEEDCGGGG |
| C5395 | CPASYFQCGNLPHCYPMEWRCDGFPDCIDGSDEKGCGGGGCQPNEFRCRSGSCIPLAWLCDGVDDCEDSSDEANCGGGG |
| C5396 | CPASYFQCGNLPHCYPMEWRCDGFPDCIDGSDEKGCGGGGCPSNQFQCKNGSCIPPSWVCDGVPDCEDNSDESEDCGGGG |
| C5397 | CPASYFQCGNLPHCYPMEWRCDGFPDCIDGSDEKGCGGGGCPSGEFPCNNGKCIPRAWLCDGEDDCGDGSDEPAQCGGGG |

TABLE 19-continued

Dkk-1 neutralizing Avimer walked dimer amino acid sequences

| Avimer | Avimer amino acid sequence |
|---|---|
| C5398 | CPASYFQCGNLPHCYPMEWRCDGFPDCIDGSDEKGCGGGGCPPDEFQCSNGNCIPPNWVCDGEDDCEDSSDESALCGGGG |
| C5399 | CPASYFQCGNLPHCYPMEWRCDGFPDCIDGSDEKGCGGGGCESDEFPCHNSDICIPGHWGCDGENDCQDDSDESSENCGGGG |
| C5400 | CPASYFQCGNLPHCYPMEWRCDGFPDCIDGSDEKGCGGGGCVPNQFKCGNGHCIPGHWVCDGEDDCGDNSDESPAHCGGGG |
| C5401 | CEPNQFKCKNGNSVPEHWVCDGEDDCGDGSDEANCGGGGCPSNEFMCPDKVCFPWSFLCDGDNDCQDGSDEEYCGGGG |
| C5402 | CHPTDQFECGNGRCISANWVCDGEDDCGDGSDESPDLCGGGGCPSNEFMCPDKVCFPWSFLCDGDNDCQDGSDEEYCGGGG |
| C5403 | CPASYFQCGNLPHCYPMEWRCDGFPDCIDGSDEKGCGGGGCPSNEFMCPDKVCFPWSFLCDGDNDCQDGSDEEYCGGGG |
| C5404 | CPPDEFQCDNGRCIPEDWLCDGENDCGDGSDEANCGGGGCPSNEFMCPDKVCFPWSFLCDGDNDCQDGSDEEYCGGGG |
| C5405 | CPSGEFQCDSGSCIPEDWVCDGENDCEDGSDEALDNCGGGGCPSNEFMCPDKVCFPWSFLCDGDNDCQDGSDEEYCGGGG |

Isolation of Neutralizing Anti-SOST Peptides

TN7 Library (diversity: 2.3×109, 2.3×10[11] pfu panned), TN8 Library (diversity: 5×109, 5×10[11] pfu panned), TN12 Library (diversity: 1.4×109, 1.4×1011 pfu panned), and Linear Library (diversity: 1.05×1010, 1.05×10[11] pfu panned) from Dyax Corp. (55 Network Drive Burlington, Mass. 01803) were subtracted with biotinylated human WISE and biotinylated avi-human ERK2 coated Streptavidin magnetic beads (Dynal), then panned against biotinylated recombinant avi-Human Sclerostin coated Streptavidin magnetic beads. Bound phages were eluted with anti-SOST Ab mixture, mLRP6-His, or TEA. Output phage pools were subjected to an additional subtraction step with biotin human WISE coated Streptavidin magnetic beads. After three rounds of panning, peptide phage clones were screened for SOST binding and counter-screened for no huWISE binding by ELISA. Neutralizing anti-SOST peptide phages were identified by competition ELISA in the presence of three neutralizing anti-SOST antibodies (AB5, 47B10, and 38B12). A total of 48 neutralizing peptides were identified from RD2 pools (see table 20) and 47 from RD3 pools (see table 21).

TABLE 20

Sequences of peptides from RD2 pools of primary screen

| clone # | Peptide Sequence |
|---|---|
| R2.1 | SNICEEPYWCWWD |
| R2.2 | AFYCNEDTWCFYE |
| R2.5 | FNICNDGFVCWFE |
| R2.9 | DLRCGFEVLCWTP |
| R2.15 | YYACNHDGWCFYE |
| R2.16 | EVDCIWKGTWCWVV |
| R2.39 | PLSCEWHNGWCWVM |
| R2.40 | WRECPGEWYYCEMW |
| R2.41 | MGKCAWSSGWCFIG |
| R2.42 | YIGCVWNAGWCWVE |
| R2.49 | EFDCYWHEDWCWIE |
| R2.50 | SSWCPFGWADCLQY |
| R2.57 | EIDCNWWMYDCWSF |
| R2.59 | FRLCRDRLLDQYVICSDF |
| R2.70 | PPMCEDKNQYWQSICWLA |
| R2.72 | LPFCEEESYQDWSACWLH |
| R2.77 | LSNCESPFSPWMSICWLP |
| R2.81 | FYICPSSHDDFWDICALS |
| R2.82 | NWFCITPETGELNPCEPS |
| R2.83 | LPRCLDETVSSFPLCWLD |
| R2.84 | DLCGKNWNDNSFHCWWY |
| R2.86 | LYNCVWERKGNWTFCVDD |
| R2.92 | WLECEDLEGRKHTCWFS |
| R2.94 | YFDCVRQHQGWDSMCFYD |
| R2.95 | FRLCVDTEQGYWHICDDW |
| R2.104 | LYQCSDINADDYWACWLD |
| R2.105 | DLWCINREGFLFPCYRD |
| R2.107 | LPFCLNVPEDYTFACWAG |

TABLE 20-continued

Sequences of peptides from RD2 pools of primary screen

| clone # | Peptide Sequence |
|---|---|
| R2.108 | LNACLDDPFSTACWLN |
| R2.109 | SSFCHWYDGDTSEPCFFL |
| R2.114 | FWICDVGSSTQHWCLWD |
| R2.115 | HWLCNGWQANWMDICLGH |
| R2.116 | LPLCMIRPNSPQWACWLD |
| R2.120 | WVECNGWFVSEWDMCMLD |
| R2.124 | DLFCMNPDGWFLSPCVDH |
| R2.125 | LPFCSEVDLMDHQMCWLH |
| R2.127 | WHICPSPYAFEWMLCSDY |
| R2.136 | FLYPCDWRSFGSQALCWLD |
| R2.143 | AYYCIDSQDWTLFTCKD |
| R2.157 | LLACSALHNDQGSMCWLD |
| R2.159 | PPRCADLLRASQGICFLD |
| R2.170 | WALCEADNQEDWFICPWN |
| R2.172 | AWECEYNGEWCFLH |
| R2.173 | LRNCEMLDWNDFGLCWFS |
| R2.175 | NGQCWKTSHPQVGNCVGN |
| R2.177 | AWECEYNGEWCFLH |
| R2.180 | WEPCFFEEFCLIE |
| R2.182 | WPLCQAEWEGWYEPCMYW |

TABLE 21

| clone # | peptide Sequence |
|---|---|
| R3.4 | LSWCTDMDPSFWGTCWLA |
| R3.5 | WFNCDMYSGQFRQHCDRH |
| R3.6 | WYPCGEEWYDCWMS |
| R3.8 | LLACGFDGHQRETMCWLD |
| R3.9 | PPHCKEVHPQSGSGCWNP |
| R3.11 | LPACWDDVNYESTACWLD |
| R3.16 | LNWCTWEDEASSTMCWLN |
| R3.19 | NGDCELVKGPVDWECKPA |
| R3.20 | LPDCKDATWNSFSACWLD |
| R3.26 | YAECMDSLEQLDYNCFLP |
| R3.29 | LFSCDDTSAMQSTMCWLP |
| R3.32 | DWVCGVDIECEMW |
| R3.41 | LNLCWENQPDDDSACWLD |
| R3.49 | EQDCGQEWLYCEFI |
| R3.51 | WSICEEGYKCWWE |
| R3.52 | PPRCADLLRASQGICFLD |
| R3.57 | SDICYWSEGWCWIE |
| R3.59 | DTNCMWRDGWCFLQ |
| R3.61 | DAACWLQMRGSTWECVYH |
| R3.64 | LPMCTYMGSTWTEMCWLD |
| R3.71 | KPMCHPQNHCEEE |
| R3.76 | YWNCETDSFCLWQ |
| R3.77 | DLVCGVDVMCWYL |
| R3.85 | NVVCNGDNWCFYV |
| R3.86 | DLRCGFEVLCWTP |
| R3.90 | NWNCLDAHPQVGTNCEYN |
| R3.94 | NGQCWKTSHPQVGNCVGN |
| R3.97 | DIECSEVDWCWED |
| R3.98 | LHACKNHKYGYQSLCWLD |
| R3.99 | PPLCEDSSTSFETVCFLD |
| R3.100 | YRVCTDKSNQNWVLCSFD |
| R3.102 | LPDCETQAGKHAMLCWLN |
| R3.104 | DWYCLSNDHSTLVQCEDY |
| R3.107 | WFLCDTQDHKHWQLCANP |
| R3.109 | PPLCKDVRGQYFGMCFLS |
| R3.112 | LPHCDAQENPYATLCWWD |
| R3.115 | GVYCNKQGWCFYS |
| R3.116 | YKECHPQGEHCFEF |
| R3.122 | WRECPGEWYYCEMW |
| R3.128 | LRFCRDGGVDTTWICWYD |
| R3.132 | ELICWNDNWCYIE |
| R3.136 | DDGCWLMKNGNFWQCSNS |
| R3.137 | IYRCKSSFDQCLMY |
| R3.142 | LYYCGDDLYCFDI |
| R3.143 | FNICNDGFVCWFE |
| R3.149 | EFDCYWHEDWCWIE |
| R3.159 | DWWCIDHTSGKLMPCQNS |

Peptibody Conversion and Screening

Figure 27B:
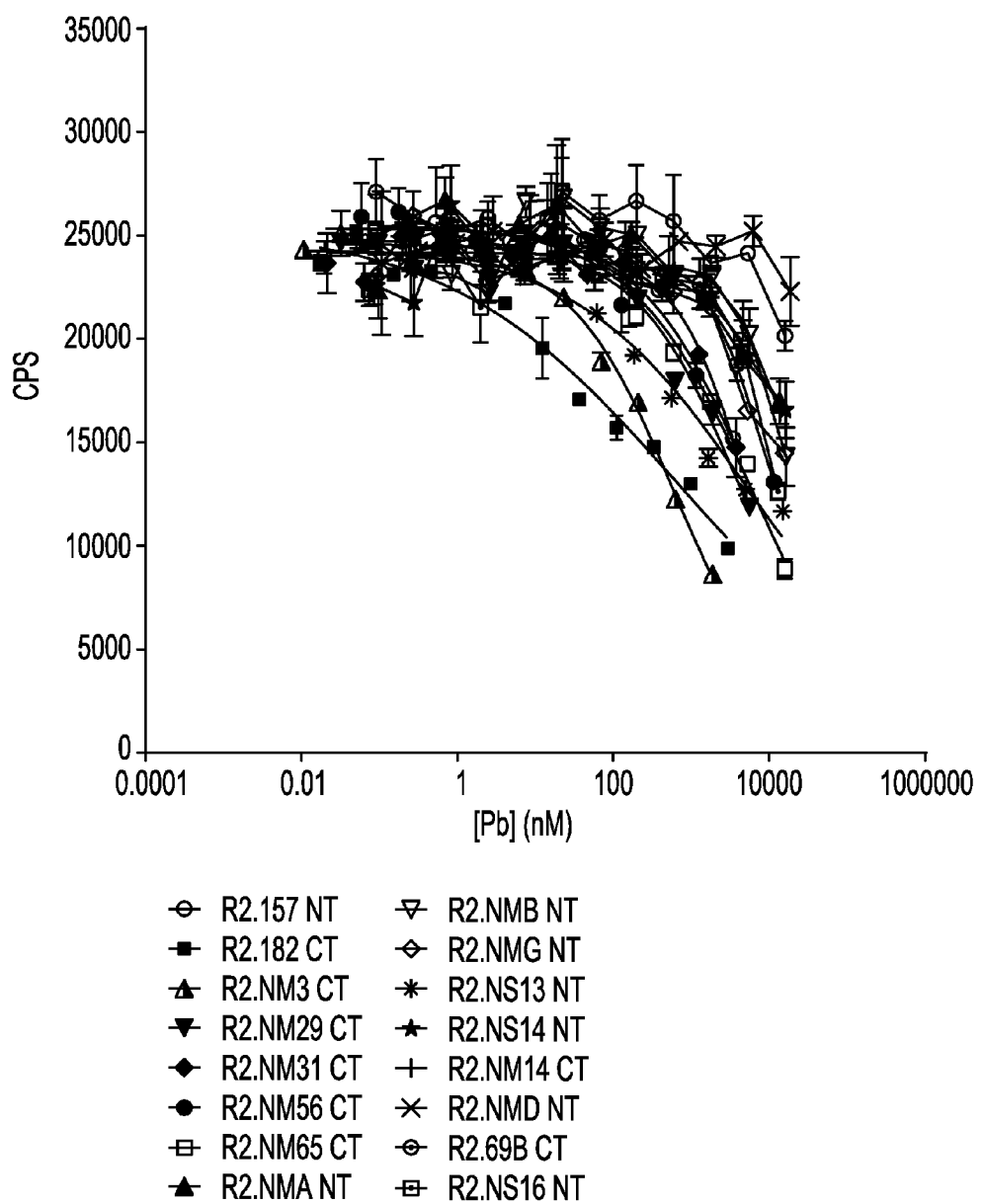
Figure 28A:
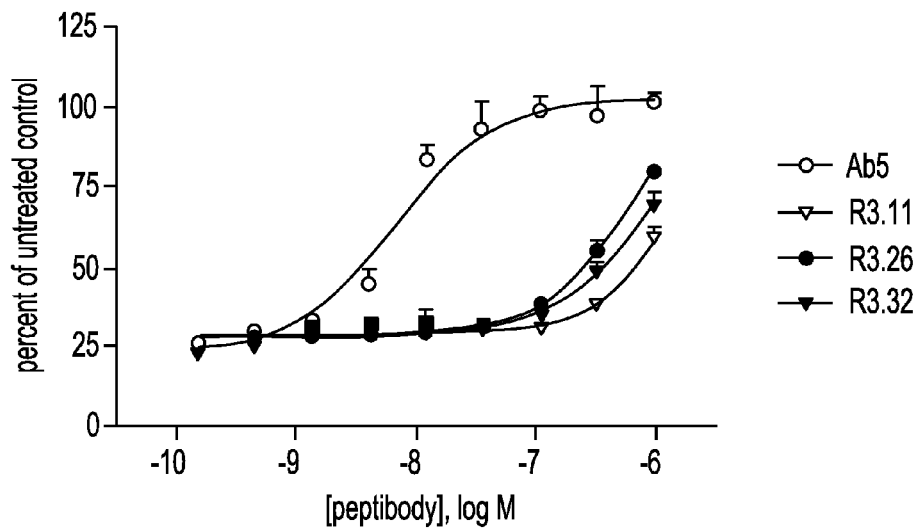
FIG. 28A-D: WNT1 assay of selected anti-SOST peptibodies from primary screen.
Figure 28B:
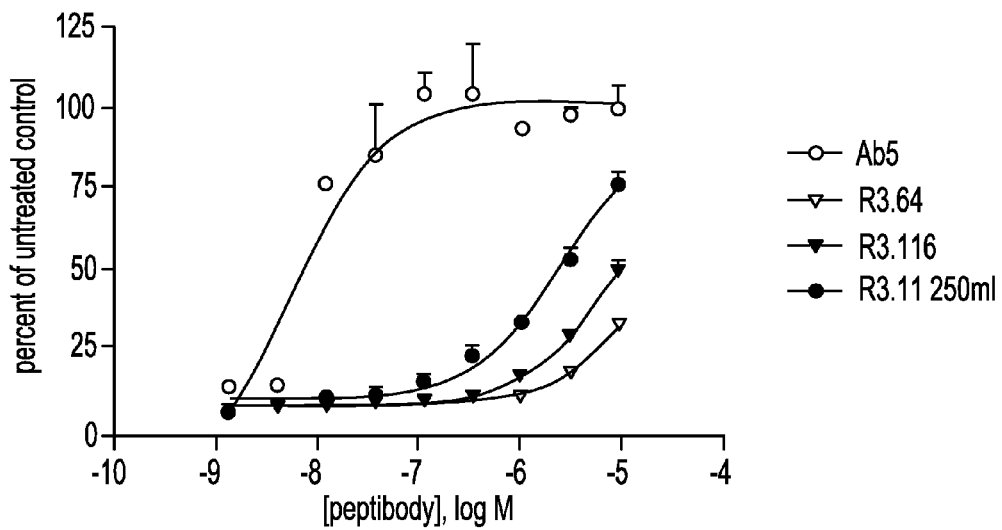
Figure 28C:
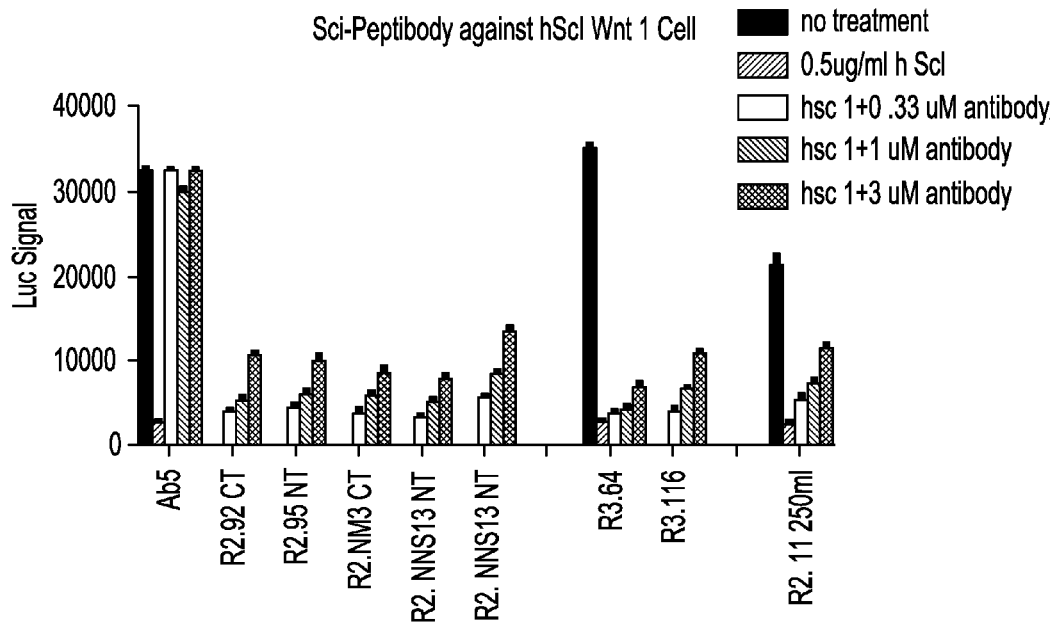
Figure 28D:
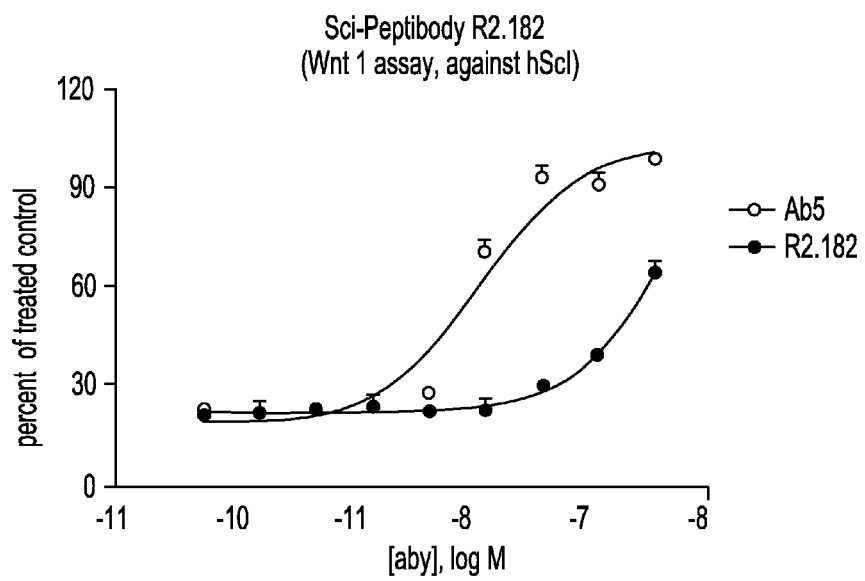

Selected peptides were converted to peptibodies in bulk by fusing the peptide sequence flanked by TCCATGGC-CGCTGAGGGCACCGGTGAC and CCTGATCCTGGC-CCTACCGACAACTCTGCAG as NcoI-PstI fragments to N-terminus and C-terminus of the human Fc linked with a G5 linker in between in pTT5 vector. Converted peptibodies were expressed transiently in 293 6E cells and purified using MabSelect resin in an AKTA purification system. Purified peptibodies were screened by SOST binding ELISA, anti- SOST Ab competition ELISA, and competition AlphaScreen assay with anti-SOST Loop2 Ab and LRP6 (see paragraph [00183]) to confirm their SOST neutralizing activity. They were counter-screened against huWISE by ELISA and AlphaScreen assay for no huWISE binding. Most peptibodies showed some degree of LRP6 inhibition activity (See FIG. 27).

Fifteen peptibodies showing LRP6 inhibition activity in rat SOST/muLRP6 AlphaScreen assay were screened in WNT1 assay (see [00185]). Five peptibodies (R3-11, R3-26, R3-32, R3-86B, and R2-182) with 529 nM-1.62 µM EC50 in WNT1 assay (See FIG. 28) and 6.33 nM-6.5 µM IC50 in AlphaScreen LRP6 competition assay were selected for affinity maturation (see table 22).

TABLE 22

Amino acid sequences and inhibitory activities of the selected four anti-SOST peptides for affinity maturation

| clone | peptide sequence | SOST WNT1 assay $EC_{50}$ | Rat Sclerostin/ muLRP6-his AlphaScreen assay $IC_{50}$ |
|---|---|---|---|
| R3.11 | LPACWDDVNYESTACWLD | 1.62 uM | 153.4 nM |
| R3.26 | YAECMDSLEQLDYNCFLP | 529 nM | 6.33 nM |
| R3.32 | DWVCGVDIECEMW | 861 nM | 507.8 nM |
| R2.182 | WPLCQAEWEGWYEPCMYW | 802 nM | NA |

Affinity Maturation of Anti-SOST Peptides

Mutagenesis oligos were designed using 91% doped degenerate codon NNK, where N represents a mixture of 91% wild type nucleotide and 3% each of the other three nucleotides and K represents a mixture of 50% thymine and 50% guanine Mutations were introduced to all nucleotide residues coding the peptide except for the nucleotide residues (TGC and TGT) coding for the two Cysteines. Additional three randomized NNK codons were added to the 5' end and the 3' end of the peptide coding region. Due to the length of the coding region, three mutagenesis oligos with flanking (NNK)3 plus the adaptor TTCTATTCTCACAGTGCACAGGGT at the 5' end and the adaptor CATTCTCTCGAGACTGTTGAAAGT at the 3' end were designed: (1) mutA oligo contains mutations in the nucleotides coding the front half of the peptide, (2) mutB oligo contains mutations in the nucleotides coding the back half of the peptide, and (3) mutt oligo contains mutations in the every nucleotides coding the entire peptide. The adaptors were added to introduce an ApaLI site (GTGCAC) and XhoI site (CTCGAG) flanking the peptide sequence and provide priming region for cloning purpose.

Construction of Control Peptide Phagemids

The peptide regions of the four selected peptide phage plus the flanking 5' and the 3' adaptors (mentioned above) were amplified with primers 6094-97 (TTCTATTCTCACAGTGCACAGGGT) and 6094-98 (ACTTTCAACAGTCTCGAGAGAATG) and cloned into pCES1 TQ modified phagemid vector at ApaLI and XhoI site to form phagemid phage controls R3.11A, R3.26A, R3.32A, R2.182A. In order to match the size of the mutant peptides flanked by (NNK)3, another set of phagemid phage controls R3.11B, R3.26B, R3.32B, R2.182B with additional G3 residues flanking the parental peptide were also made. These controls were used to set the stringent screening conditions for selection of affinity improved mutants. Unlike the primary peptide phage displaying five-copies of peptide, the phagemid phage display only one copy of the peptide. The screening conditions were set in such a way that the parental phagemid phage controls either do not bind or bind weakly to the antigen under the set conditions.

Mutant Peptide Phagemid Library Construction and Panning

Mutagenesis oligos were amplified with primers 6094-97 (TTCTATTCTCACAGTGCACAGGGT) and 6094-98 (ACTTTCAACAGTCTCGAGAGAATG). The resulted mutant peptide library fragments were digested with ApaLI and XhoI and cloned into pCES1 phagemid vector in frame at the N terminus of gene III. Ligation mixtures were used to transform XL1 Blue to generate four mutant peptide phagemid libraries of 2.7E8-5.3E8 diversities. Mutant phagemid phage libraries were rescued in XL1Blue cells using M13KO7 helper phage, precleared with huWISE and Avi-ERK coated Streptavidin beads and panned against hu-SOST as described above at significantly reduced antigen bead-coating concentrations as low as 0.001 ug/ml with increased number of washes and an overnight wash, aiming to recover only the most tightly bound phagemid phage.

Screening of Affinity Improved Peptide Phagemid Clones

Phagemid clones, obtained after three rounds of panning with final antigen bead-coating concentration at 0.025 µg/ml or 0.01 µg/ml, were screened by ELISA at 0.025 µg/ml antigen plate-coating concentration and compared to the parental phagemid phage. At 0.01 µg/ml antigen plate-coating concentration, the parental R3.11, R3.26, and R3.32 phagemid phage showed no binding to SOST, yet their corresponding mutants showed different degree of binding suggesting improved affinity. Under the same ELISA condition, the parental R3.182 showed weaker binding than some of the corresponding mutants. A total of 16 R3.11 mutants, 31 R3.26 mutants, and 8 82.182 mutants (see table 23) were selected to be reformatted into pepti-Ig molecules.

TABLE 23

Affinity matured anti-SOST peptide

| Affinity matured mutants | peptide sequence |
|---|---|
| 11-01 | RVLRCCQLLDYESTACWLDC |
| 11-02 | SADRQLCLSVRSGWYEPCMYWGAL |
| 11-03 | TLDLPACWDDVNYESTACWLDGGG |
| 11-04 | VEDRQLCLSQTDGWYEPCMYWGDQ |
| 11-05 | PLDLPACWDDVNYESTACWLDGGG |
| 11-06 | DLRWCSQQLEYESTACWLDE |
| 11-07 | LLSRMICQIDQTGWYEPCMYWQGS |
| 11-08 | GGGWPLCQAEWEGWYEPCMYWGWQ |
| 11-09 | QDYRSLCWMSRSGWYEPCMYWGGG |
| 11-10 | REVLCCHDLDYESTACWLDC |

TABLE 23-continued

Affinity matured anti-SOST peptide

| Affinity matured mutants | peptide sequence |
|---|---|
| 11-11 | HELVGRCSQEPSYQCRRCSVAYGQ |
| 11-12 | QFDLPACWDDVESTACWLDGGG |
| 11-13 | EIGLCSEDLNYESTACWLDE |
| 11-14 | NSDRGLCPIDSSGWYEPCMYWGEQ |
| 11-15 | NQAWVLCEAEEDGWYEPCMYWGRG |
| 11.16 | SLDRQLCFVVSEGWYEPCMYWGKD |
| 26-01 | DAFYAECMDSLEEVDYNCFLPETV |
| 26-02 | TSTYRECIDWDDQLDYNCFLPDSQ |
| 26-03 | FLVYAECMDSLEELDYNCFLPYEE |
| 26-04 | DVFYAECMDSLEEVDYNCFLPEND |
| 26-05 | SLPQRQYFQCVHQLDYNCFLPERG |
| 26-06 | FLVYRQCMDFGDQLDYNCFLPDDA |
| 26-07 | DRAYRQCIDWVDQLDYNCFLPDQS |
| 26-08 | DLQFRNCNDWVDQLDYNCFLPEPD |
| 26-09 | DVAYAECMDSLEDVDYNCFLPEDQ |
| 26-10 | FSHDRQYMLCVHQLDYNCFLPEPQ |
| 26-11 | DAFYAECMDSLEYVDYNCFLPDLA |
| 26-12 | RQDRALCWHSGEGWYEPCMYWGAA |
| 26-13 | DQVWRDCIDWVHQLDYNCFLPDDE |
| 26-14 | DVFYAECMDSLEQIDYNCFLPELQ |
| 26-15 | DTPYRLCRDWVEQLDYNCFLPESD |
| 26-16 | SVLYAECMDWEQQLDYNCFLPDED |
| 26-17 | VIFYAECMDSLEELDYNCFLPEPE |
| 26-18 | YSQYAECMDSLEELDYNCFLPETE |
| 26-19 | WVAYRQCIDSVHQLDYNCFLPDWD |
| 26-20 | FVFYAECMDSLEELDYNCFLPMTE |
| 26-21 | SIPYRECMDWVDQLDYNCFLPDQD |
| 26-22 | TRAYRECIHFVHQLDYNCFLPDED |
| 26-23 | TVYYRQCMDWVDQLDYNCFLPEDH |
| 26-24 | YQANRQYMQCAHQLDYNCFLPDWW |
| 26-25 | DALYLNCIQWVDQLDYNCFLPDDE |
| 26-26 | LRQYRQCIDWGQQLDYNCFLPMEE |
| 26-27 | TVAYAECMDSLEELDYNCFLPQEL |
| 26.28 | VVRYRPCMDWGQQLDYNCFLPDGQ |
| 26.29 | SYMYRHYFQCVQQLDYNCFLPEQT |
| 26.30 | WWQLRDCKHWEHQLDYNCFLPWAE |
| 26.31 | VVYYAECMDSLEEVDYNCFLPYEQ |
| 182-01 | YGDRNLCYDQDSGWYEPCMYWTEG |
| 182-02 | GGTRELCWLAAQGWYEPCMYWAEG |
| 182-03 | GGGWPLCQAEWEGWYEPCMYWGYY |
| 182-04 | GGTRQLCLSEPFGWYEPCMYWGAS |
| 182-05 | GGGWPLCQAEWEGWYEPCMYWGAG |
| 182-06 | GGGWPLCQAEWEGWYEPCMYWGVG |
| 182-07 | FADREVCYLPERGWYEPCMYWGSQ |
| 182-08 | DGDRAICFNSHQGWYEPCMYWAGR |

Pepti-Ig Conversion

Affinity matured anti-SOST peptides (see table 5) were converted to 1X pepti-Ig (see FIG. 4) by fusing to the C-terminus of the del-K HC of anti-DKK antibody 6.147.4 after a G4 linker by Seamless cloning into the EcoRI/NotI digested pTT5 vector. For two affinity matured peptides (26-09 and 26-11), two copies of the same peptide flanking a G4S linker were fused to the C-terminus of the del-K HC of 6.147.4 after a G4 linker to form 2X pepti-Ig (see FIG. 30A). Different codons for the same amino acids, where possible, were used for the coding nucleotides of the duplicated copies of the same peptide in the 2X pepti-Ig molecules to avoid homologous recombination during cloning process.

Selection of Top Pepti-Ig Molecule

Figure 29:
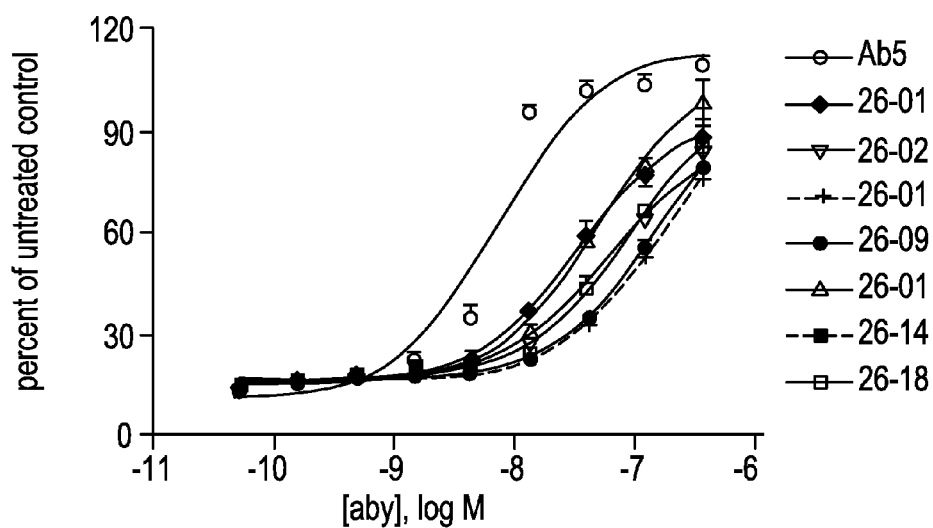
FIG. 29: SOST inhibition activity of affinity matured 1X pepti-Igs.

Thirty seven small scale purified pepti-Ig molecules were tested for the SOST inhibitory activity in WNT1 assay. Seven top SOST inhibitory 1X pepti-Ig molecules were identified (see Table 24, FIG. 29). These top 1X pepti-Ig molecules were tested in SOST/LRP6 inhibition and DKK1/LRP6 inhibition AlphaScreen assay and confirmed to be dual SOST/DKK1 inhibitory (data not shown). The dual SOST/DKK1 inhibitory activity of these molecules was confirmed in WNT1 assay against SOST and DKK-1 respectively using large scale materials (Table 25). Large-scaled-purified 1X pepti-Ig materials were exposed to stressed conditions (37 C for 42 hours and freeze/thaw for three times). The stressed materials were tested in SOST WNT1 assay and shown to be very stable under these conditions and retain their activity similar to that of unstressed materials (data not shown). To further improve the affinity, 2X pepti-Ig version of the two top 1X pepti-Ig, 26-09 and 26-11, were made and tested in WNT1 assay against huSOST. Although 2X 26-11 pepti-Ig completely lost the inhibitory activity, 2X 26-09 pepti-Ig showed about 4-fold improvement in the SOST inhibitory activity (18.6 nM) from that of 1X 26-09 pepti-Ig (66.7 nM). Its activity was comparable to the activity of a bispecific hetero-Ig composed of the same anti-DKK-1 Ab (6.147) and an anti-SOST Ab (see FIG. 30).

TABLE 24

SOST inhibitory activity of top seven 1X pepti-Ig containing affinity matured anti-SOST peptides

| 1X pepti-Ig | affinity matured anti-SOST peptide Sequence | WNT 1 assay EC$_{50}$ (nM) |
|---|---|---|
| parent | YAECMDSLEQLDYNCFLP | |
| 26-01 | DAFYAECMDSLEEVDYNCFLPETV | 104.0 |
| 26-02 | TSTYRECIDWDDQLDYNCFLPDSQ | 60.7 |
| 26-04 | DVFYAECMDSLEEVDYNCFLPEND | 162.3 |
| 26-09 | DVAYAECMDSLEDVDYNCFLPEDQ | 34.2 |
| 26-11 | DAFYAECMDSLEYVDYNCFLPDLA | 52.7 |
| 26-14 | DVFYAECMDSLEQIDYNCFLPELQ | 156.7 |
| 26-18 | YSQYAECMDSLEELDYNCFLPETE | 88.3 |

TABLE 25

| pepti-Ig | Protein seq | peptide Sequence |
|---|---|---|
| 26-02 1X pepti-Ig | QVQLVESGGGVVQPGRSLRLSCAASGFTFSRYDMHWVRQAPGK GLEWVAIIFYDGSNKYYADPVKGRFTISRDNSKNTLYLQMNSL RAEDTAVYYCATLAAAFDYWGQGTLVTVSSASTKGPSVFPLAP CSRSTSESTAALGCLVKDYFPEPVTVSWNSGALTSGVHTFPAV LQSSGLYSLSSVVTVPSSNFGTQTYTCNVDHKPSNTKVDKTVE RKCCVECPPCPAPPVAGPSVFLFPPKPKDTLMISRTPEVTCVV VDVSHEDPEVQFNWYVDGVEVHNAKTKPREEQFNSTFRVVSVL TVVHQDWLNGKEYKCKVSNKGLPAPIEKTISKTKGQPREPQVY TLPPSREEMTKNQVSLTCLVKGFYPSDIAVEWESNGQPENNYK TTPPMLDSDGSFFLYSKLTVDKSRWQQGNVFSCSVMHEALHNH YTQKSLSLSPGGGGGTSTYRECIDWDDQLDYNCFLPDSQ | TSTYRECIDWDDQLDYNCFLPDSQ |
| 26-09 1X pepti-Ig | QVQLVESGGGVVQPGRSLRLSCAASGFTFSRYDMHWVRQAPGK GLEWVAIIFYDGSNKYYADPVKGRFTISRDNSKNTLYLQMNSL RAEDTAVYYCATLAAAFDYWGQGTLVTVSSASTKGPSVFPLAP CSRSTSESTAALGCLVKDYFPEPVTVSWNSGALTSGVHTFPAV LQSSGLYSLSSVVTVPSSNFGTQTYTCNVDHKPSNTKVDKTVE RKCCVECPPCPAPPVAGPSVFLFPPKPKDTLMISRTPEVTCVV VDVSHEDPEVQFNWYVDGVEVHNAKTKPREEQFNSTFRVVSVL TVVHQDWLNGKEYKCKVSNKGLPAPIEKTISKTKGQPREPQVY TLPPSREEMTKNQVSLTCLVKGFYPSDIAVEWESNGQPENNYK TTPPMLDSDGSFFLYSKLTVDKSRWQQGNVFSCSVMHEALHNH YTQKSLSLSPGGGGGDVAYAECMDSLEDVDYNCFLPEDQ | DVAYAECMDSLEDVDYNCFLPEDQ |
| 26-11 1X pepti-Ig | QVQLVESGGGVVQPGRSLRLSCAASGFTFSRYDMHWVRQAPGK GLEWVAIIFYDGSNKYYADPVKGRFTISRDNSKNTLYLQMNSL RAEDTAVYYCATLAAAFDYWGQGTLVTVSSASTKGPSVFPLAP CSRSTSESTAALGCLVKDYFPEPVTVSWNSGALTSGVHTFPAV LQSSGLYSLSSVVTVPSSNFGTQTYTCNVDHKPSNTKVDKTVE RKCCVECPPCPAPPVAGPSVFLFPPKPKDTLMISRTPEVTCVV VDVSHEDPEVQFNWYVDGVEVHNAKTKPREEQFNSTFRVVSVL TVVHQDWLNGKEYKCKVSNKGLPAPIEKTISKTKGQPREPQVY TLPPSREEMTKNQVSLTCLVKGFYPSDIAVEWESNGQPENNYK TTPPMLDSDGSFFLYSKLTVDKSRWQQGNVFSCSVMHEALHNH YTQKSLSLSPGGGGGDAFYAECMDSLEYVDYNCFLPDLA | DAFYAECMDSLEYVDYNCFLPDLA |
| 26-16 1X pepti-Ig | QVQLVESGGGVVQPGRSLRLSCAASGFTFSRYDMHWVRQAPGK GLEWVAIIFYDGSNKYYADPVKGRFTISRDNSKNTLYLQMNSL RAEDTAVYYCATLAAAFDYWGQGTLVTVSSASTKGPSVFPLAP CSRSTSESTAALGCLVKDYFPEPVTVSWNSGALTSGVHTFPAV LQSSGLYSLSSVVTVPSSNFGTQTYTCNVDHKPSNTKVDKTVE RKCCVECPPCPAPPVARPSVFLFPQKPKDTLMISRTPEVTCVV VDVSHEDPEVQFNWYVDGVEVHNAKTKPREEQFNSTFRVVSVL TVVHQDWLNGKEYKCKVSNKGLPAPIEKTISKTKGQPREPQVY TLPPSREEMTKNQVSLTCLVKGFYPSDIAVEWESNGQPENNYK TTPPMLDSDGSFFLYSKLTVDKSRWQQGNVFSCSVMHEALHNH YTQKSLSLSPGGGGGSVLYAECMDWEQQLDYNCFLPDED | SVLYAECMDWEQQLDYNCFLPDED |
| 26-18 1X pepti-Ig | QVQLVESGGGVVQPGRSLRLSCAASGFTFSRYDMHWVRQAPGK GLEWVAIIFYDGSNKYYADPVKGRFTISRDNSKNTLYLQMNSL RAEDTAVYYCATLAAAFDYWGQGTLVTVSSASTKGPSVFPLAP CSRSTSESTAALGCLVKDYFPEPVTVSWNSGALTSGVHTFPAV LQSSGLYSLSSVVTVPSSNFGTQTYTCNVDHKPSNTKVDKTVE RKCCVECPPCPAPPVAGPSVFLFPPKPKDTLMISRTPEVTCVV VDVSHEDPEVQFNWYVDGVEVHNAKTKPREEQFNSTFRVVSVL TVVHQDWLNGKEYKCKVSNKGLPAPIEKTISKTKGQPREPQVY | YSQYAECMDSLEELDYNCFLPETE |

TABLE 25-continued

| pepti-Ig Protein seq | peptide Sequence |
|---|---|
| TLPPSREEMTKNQVSLTCLVKGFYPSDIAVEWESNGQPENNYK<br>TTPPMLDSDGSFFLYSKLTVDKSRWQQGNVFSCSVMHEALHNH<br>YTQKSLSLSPGGGGGYSQYAECMDSLEELDYNCFLPETE | |

Bispecific Peptibody Assays

The ability of the bispecific peptibodies to activate canonical Wnt signaling in the presence of sclerostin and/or Dkk1 (data not shown) was evaluated in an independent osteoblast Wnt activation assay where cells are induced to differentiate and secrete factors that activate Wnt signaling in an autocrine fashion. In the assay, MC3T3-E1 cells were transfected with a Super-TOPFlash reporter construct, and stable cell lines were selected and evaluated. MC3T3E1/TetONWnt1/Luciferase is a mouse osteoblast cell line engineered with a T-Cell factor response luciferase construct, Tet Repressor construct and a doxycycline inducible Wnt-1 construct using lentiviral transduction. In the presence of doxycycline, the MC3T3E1/TetONWnt1/Luc cells express Wnt-1 and induce signal transduction via the binding of Wnt-1 to cell surface LRP5/6 and Frizzled receptors resulting in the expression of luciferase. When MC3T3E1/TetONWnt1/Luc#5 cell were incubated in the presence of sclerostin and/or DKK1 Wnt signaling is inhibited by these proteins via the Lrp5/6 beta propeller 1 motif. The bioassay measured the dose dependent stimulatory effect in the cell-based reporter assay of the bispecific peptibodies and parental antibodies treated with a fixed concentration of sclerostin and/or DKK1.

Figure 30:
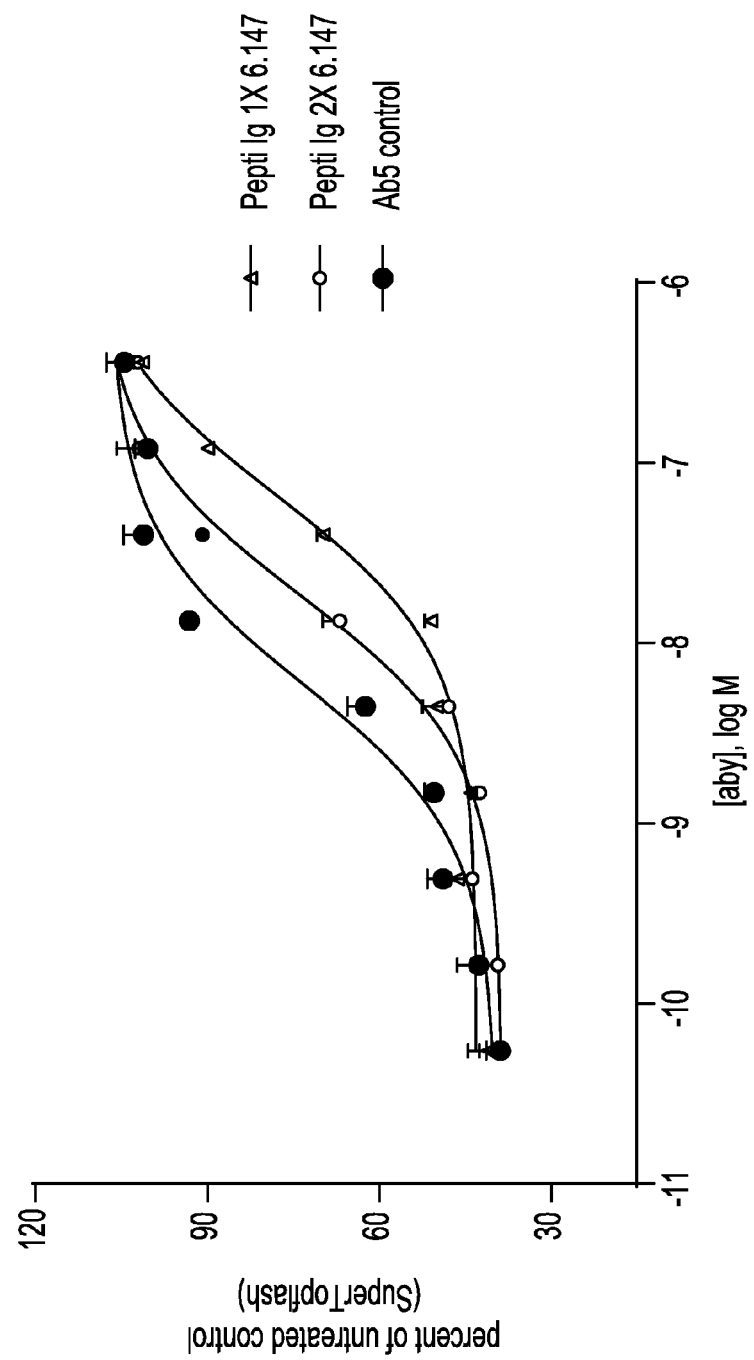
FIG. 30: Neutralizing activity of bispecific pepti Igs against Sclerostin in an osteoblast Wnt signaling assay.

Pepti Ig bispecific antibodies, Pepti Ig 1X-6.147 and 2X-6.147, were capable of dose-dependently activating the osteoblast canonical Wnt pathway in the presence of both sclerostin and DKK1, further demonstrating that the antibodies can simultaneously neutralize the Wnt inhibitory function of both soluble proteins. FIG. 30 shows neutralizing activity of bispecific pepti-Igs against Sclerostin in an osteoblast Wnt signaling assay.

The following demonstrates that bispecific peptibodies generated according to the methods described herein increased bone mineral density in vivo.

Male 10 week old B6D2F1 mice were used in this study. At the beginning of the study, animals were divided into 4 groups (n=6/group) and balanced by both body weight and bone mineral density (BMD) at the femur-tibia region by in vivo DXA. Mice were subcutaneously injected with either vehicle (proline) or Dkk1-Ab (Scl-Ab), or Peptibody 1X-6.147 or Pepti-Ig 2X-6.147 every other day for 3 weeks. The antibodies were dosed at 12.5 mg/ml. Animals were scanned weekly by in vivo DXA to monitor the bone anabolic activity of the drug treatments at lumbar vertebral (not shown) and femur-tibia regions.

Figure 31:
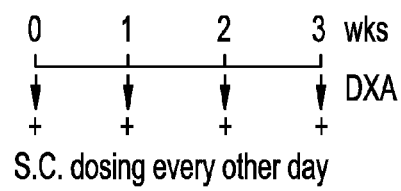
FIG. 31: Pepti Ig PK/PD study in intact mice
Figure 32A:
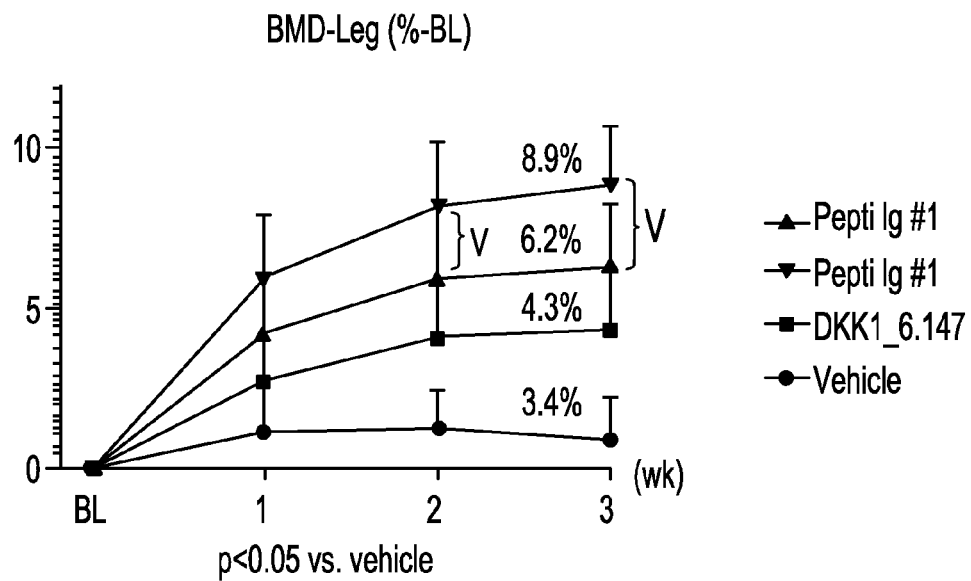
FIG. 32: Bispecific Pepti Igs Increased bone mass in femur-tibia (in vivo DXA analysis).
Figure 32B:
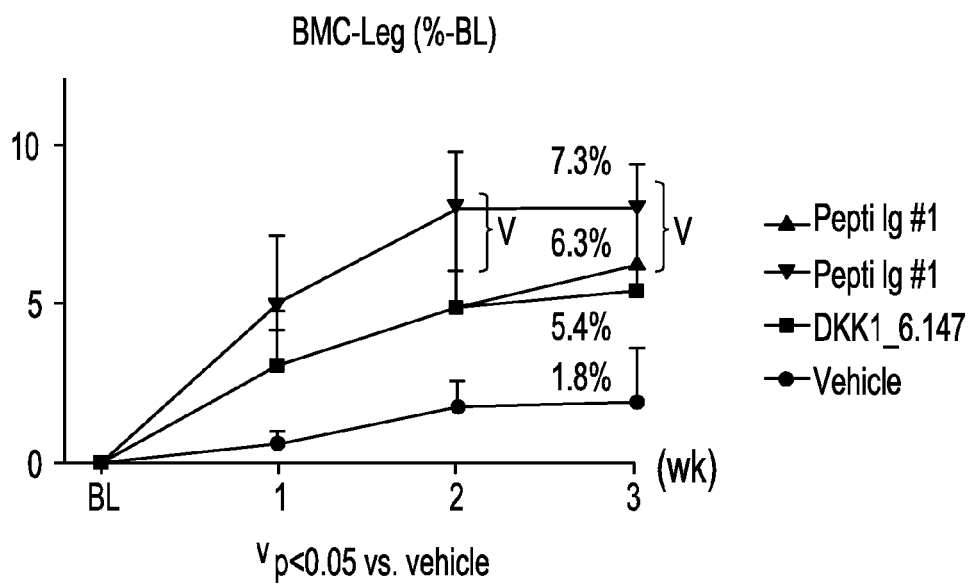

FIG. 31 illustrates the in vivo study design for the following heterodimeric antibodies: (1) Dkk1-Ab (2) Pepti Ig 1X and (3) Pepti Ig 2x. Dkk1 Ab is used as mono-therapy control. FIG. 32 shows a comparison of percentage increase in bone mass density (BMD) in femur-tibia in mice between monospecific Ig (Dkk1 Ab 6.147), bispecific Pepti Ig 1X-6.147 and bispecific Pepti Ig 2X-6.147 at weeks 1, 2 and 3.

SEQUENCE LISTING (744 sequences)

SEQ ID NO: 1 - protein, 28 aa, Artificial Sequence
  Description of Artificial Sequence: Synthetic peptide
  MOD_RES (3)..(3): Any amino acid
  MOD_RES (5)..(5): Any amino acid
  MOD_RES (8)..(8): Any amino acid
  MOD_RES (12)..(13): Any amino acid
  MOD_RES (15)..(15): Any amino acid
  MOD_RES (19)..(19): Any amino acid
  MOD_RES (25)..(25): Any amino acid
EFXCXNGXCIPXXWXCDGXDDCGDXSDE

SEQ ID NO: 2 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWVCDGXXDCRDXSDE

SEQ ID NO: 3 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWLCDGXXDCRDXSDE

SEQ ID NO: 4 - protein, 37 aa, Artificial Sequence
  Description of Artificial Sequence: Synthetic polypeptide
CHPTGQFRCRSSGRCVSPTWVCDGDNDCGDNSDEENC

SEQ ID NO: 5 - protein, 34 aa, Artificial Sequence
  Description of Artificial Sequence: Synthetic polypeptide
  MOD_RES (2)..(4): Any amino acid
  MOD_RES (5)..(5): Glu or Gln
  MOD_RES (7)..(7): Any amino acid
  MOD_RES (9)..(9): Any amino acid
  MOD_RES (12)..(12): Any amino acid
  MOD_RES (15)..(15): Ile or Val
  MOD_RES (16)..(18): Any amino acid
  MOD_RES (20)..(20): Any amino acid
  MOD_RES (30)..(30): Any amino acid
  MOD_RES (34)..(34): Any amino acid
CXXXXFXCXSTXRCXXXXWXCDGDNDCEDXSDEX

SEQ ID NO: 6 - protein, 35 aa, Artificial Sequence
  Description of Artificial Sequence: Synthetic polypeptide
  MOD_RES (2)..(5): Any amino acid
  MOD_RES (6)..(6): Glu or Gln
  MOD_RES (10)..(10): Any amino acid
  MOD_RES (13)..(13): Any amino acid
  MOD_RES (16)..(16): Ile or Val
  MOD_RES (17)..(19): Any amino acid
  MOD_RES (21)..(21): Any amino acid
  MOD_RES (25)..(25): Any amino acid
  MOD_RES (31)..(31): Any amino acid
  MOD_RES (35)..(35): Any amino acid
CXXXXXFECXSTXRCXXXXWXCDGXNDCEDXSDEX

SEQ ID NO: 7 - protein, 36 aa, Artificial Sequence
  Description of Artificial Sequence: Synthetic polypeptide
  MOD_RES (2)..(5): Any amino acid
  MOD_RES (6)..(6): Glu or Gln
  MOD_RES (8)..(8): Any amino acid
  MOD_RES (10)..(10): Any amino acid
  MOD_RES (13)..(13): Any amino acid
  MOD_RES (16)..(16): Ile, Leu or Val
  MOD_RES (18)..(19): Any amino acid
  MOD_RES (21)..(21): Any amino acid
  MOD_RES (25)..(26): Any amino acid
  MOD_RES (31)..(31): Any amino acid
  MOD_RES (35)..(36): Any amino acid
CXXXXXFXCXSTXRCXPXXWXCDGXXDCEDXSDEXX

SEQ ID NO: 8 - protein, 35 aa, Artificial Sequence
  Description of Artificial Sequence: Synthetic polypeptide
  MOD_RES (2)..(4): Any amino acid
  MOD_RES (5)..(5): Glu or Gln
  MOD_RES (9)..(9): Any amino acid
  MOD_RES (12)..(12): Any amino acid
  MOD_RES (15)..(15): Ile or Val
  MOD_RES (16)..(17): Any amino acid
  MOD_RES (19)..(19): Any amino acid
  MOD_RES (23)..(23): Any amino acid
  MOD_RES (33)..(34): Any amino acid
CXXXXFQCXSTXRCXXXWXCDGXNDCEDSSDEXXC

SEQ ID NO: 9 - protein, 35 aa, Artificial Sequence
  Description of Artificial Sequence: Synthetic polypeptide
  MOD_RES (2)..(5): Any amino acid
  MOD_RES (6)..(6): Glu or Gln
  MOD_RES (8)..(8): Any amino acid
  MOD_RES (10)..(14): Any amino acid
  MOD_RES (16)..(16): Ile, Leu or Val
  MOD_RES (17)..(26): Any amino acid
  MOD_RES (29)..(29): Any amino acid
  MOD_RES (31)..(31): Any amino acid
  MOD_RES (35)..(35): Any amino acid
CXXXXXFXCXXXXXCXXXXXXXXXXXDCXDXSDEX

SEQ ID NO: 10 - protein, 34 aa, Artificial Sequence
  Description of Artificial Sequence: Synthetic polypeptide
  MOD_RES (2)..(4): Any amino acid
  MOD_RES (5)..(5): Glu or Gln
  MOD_RES (7)..(7): Any amino acid
  MOD_RES (9)..(9): Any amino acid
  MOD_RES (15)..(15): Any amino acid
  MOD_RES (17)..(18): Any amino acid
  MOD_RES (20)..(20): Any amino acid
  MOD_RES (22)..(22): Any amino acid
  MOD_RES (24)..(24): Any amino acid
  MOD_RES (30)..(30): Any amino acid
  MOD_RES (34)..(34): Any amino acid
CXXXXFXCXSTGRCXPXXWXCXGXNDCEDXSDEX

SEQ ID NO: 11 - protein, 40 aa, Artificial Sequence
  Description of Artificial Sequence: Synthetic polypeptide
  MOD_RES (2)..(5): Any amino acid
  MOD_RES (6)..(6): Glu or Gln
  MOD_RES (8)..(8): Any amino acid
  MOD_RES (10)..(10): Any amino acid
  MOD_RES (13)..(13): Any amino acid
  MOD_RES (16)..(16): Ile, Leu or Val
  MOD_RES (17)..(19): Any amino acid
  MOD_RES (21)..(21): Any amino acid
  MOD_RES (23)..(26): Any amino acid
  MOD_RES (29)..(29): Any amino acid
  MOD_RES (31)..(31): Any amino acid
  MOD_RES (34)..(38): Any amino acid
  MOD_RES (40)..(40): Any amino acid
CXXXXXFXCXSTXRCXXXXWXCXXXXDCXDXSDXXXXXCX

SEQ ID NO: 12 - protein, 38 aa, Artificial Sequence
  Description of Artificial Sequence: Synthetic polypeptide
  MOD_RES (2)..(4): Any amino acid
  MOD_RES (5)..(5): Glu or Gln
  MOD_RES (7)..(7): Any amino acid
  MOD_RES (9)..(13): Any amino acid
  MOD_RES (15)..(15): Ile, Leu or Val
  MOD_RES (16)..(18): Any amino acid
  MOD_RES (20)..(20): Any amino acid
  MOD_RES (24)..(24): Any amino acid
  MOD_RES (28)..(28): Any amino acid
  MOD_RES (30)..(30): Any amino acid
  MOD_RES (32)..(32): Any amino acid
  MOD_RES (34)..(37): Any amino acid
CXXXXFXCXXXXXCXXXXWXCDGXNDCXDXSXEXXXXC

SEQ ID NO: 13 - protein, 35 aa, Artificial Sequence
  Description of Artificial Sequence: Synthetic polypeptide
  MOD_RES (2)..(5): Any amino acid
  MOD_RES (6)..(6): Glu or Gln
  MOD_RES (8)..(8): Any amino acid
  MOD_RES (10)..(10): Any amino acid
  MOD_RES (13)..(13): Any amino acid
  MOD_RES (16)..(16): Ile, Leu or Val
  MOD_RES (18)..(19): Any amino acid
  MOD_RES (21)..(21): Any amino acid
  MOD_RES (23)..(23): Any amino acid
  MOD_RES (25)..(26): Any amino acid
  MOD_RES (29)..(29): Any amino acid
  MOD_RES (31)..(31): Any amino acid
  MOD_RES (35)..(35): Any amino acid
CXXXXXFXCXSTXRCXPXXWXCXGXXDCXDXSDEX

SEQ ID NO: 14 - protein, 35 aa, Artificial Sequence
  Description of Artificial Sequence: Synthetic polypeptide
  MOD_RES (2)..(5): Any amino acid
  MOD_RES (6)..(6): Glu or Gln
  MOD_RES (8)..(8): Any amino acid
  MOD_RES (10)..(14): Any amino acid
  MOD_RES (16)..(16): Ile, Leu or Val
  MOD_RES (17)..(19): Any amino acid
  MOD_RES (21)..(21): Any amino acid
  MOD_RES (25)..(26): Any amino acid
  MOD_RES (29)..(29): Any amino acid
  MOD_RES (31)..(31): Any amino acid
  MOD_RES (35)..(35): Any amino acid
CXXXXXFXCXXXXXCXXXXWXCDGXXDCXDXSDEX

SEQ ID NO: 15 - protein, 28 aa, Artificial Sequence
  Description of Artificial Sequence: Synthetic peptide
  MOD_RES (3)..(3): Any amino acid
  MOD_RES (5)..(5): Any amino acid
  MOD_RES (8)..(8): Any amino acid
  MOD_RES (12)..(13): Any amino acid
  MOD_RES (15)..(15): Any amino acid
  MOD_RES (19)..(19): Any amino acid
  MOD_RES (25)..(25): Any amino acid
EFXCXNGXCIPXXWXCDGXDDCGDXSDE

SEQ ID NO: 16 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWVCDGXXDCRDXSDE

SEQ ID NO: 17 - protein, 26 aa, Artificial Sequence
  Description of Artificial Sequence: Synthetic peptide
  MOD_RES (2)..(2): Any amino acid
  MOD_RES (10)..(11): Any amino acid
  MOD_RES (17)..(18): Any amino acid
  MOD_RES (23)..(23): Any amino acid
CXSSGRCIPXXWLCDGXXDCRDXSDE

SEQ ID NO: 18 - protein, 29 aa, Artificial Sequence
  Description of Artificial Sequence: Synthetic peptide
  MOD_RES (1)..(1): Glu or Gln
  MOD_RES (3)..(3): Any amino acid
  MOD_RES (6)..(6): Any amino acid
  MOD_RES (7)..(7): Ser or Thr
  MOD_RES (8)..(8): Any amino acid
  MOD_RES (11)..(11): Ile or Val
  MOD_RES (12)..(12): Any amino acid
  MOD_RES (14)..(14): Any amino acid
  MOD_RES (16)..(16): Ile, Leu or Val
  MOD_RES (20)..(21): Any amino acid
  MOD_RES (24)..(24): Any amino acid
  MOD_RES (26)..(26): Asp or Asn
XFXCRXXXRCXXCXWXCDGXXDCXDXSDE

SEQ ID NO: 19 - protein, 48 aa, Artificial Sequence
  Description of Artificial Sequence: Synthetic polypeptide
CHPTGQFRCRSSGRCVSPTWVCDGDNDCGDNSDEENCSAPASEPPGSL

SEQ ID NO: 20 - protein, 36 aa, Artificial Sequence
  Description of Artificial Sequence: Synthetic polypeptide
HPTGQFRCRSSGRCVSPTWVCDGDNDCGDNSDEENC

SEQ ID NO: 21 - protein, 51 aa, Artificial Sequence
  Description of Artificial Sequence: Synthetic polypeptide
CAPNEFQCRGYNICIPQEWVCDGEDDCEDDSDETDCGDSHILPFSTPGPST

SEQ ID NO: 22 - protein, 45 aa, Artificial Sequence
  Description of Artificial Sequence: Synthetic polypeptide
CEPGQFQCHSYNKCVPPTWVCDGVLDCVDSSDEANCSQDPEFHKV

SEQ ID NO: 23 - protein, 40 aa, Artificial Sequence
  Description of Artificial Sequence: Synthetic polypeptide
CGSREFPCRGTDICLPPAWRCDGEDDCVDNSDETDCAPHT

SEQ ID NO: 24 - protein, 40 aa, Artificial Sequence
  Description of Artificial Sequence: Synthetic polypeptide
CGSSEFPCHGSDICIPQHWVCDGEDDCWDSSDEKSCEERT

SEQ ID NO: 25 - protein, 53 aa, Artificial Sequence
  Description of Artificial Sequence: Synthetic polypeptide
CGSSEFPCHGSDICISAHWRCDGDDDCGDDSDESSDNCGDSHILPFSTPGPST

SEQ ID NO: 26 - protein, 47 aa, Artificial Sequence
  Description of Artificial Sequence: Synthetic polypeptide
CGSSEFPCHGSDICISEEWGCDGVDDCEDSSDETSCSAPASEPPGSL

SEQ ID NO: 27 - protein, 42 aa, Artificial Sequence
  Description of Artificial Sequence: Synthetic polypeptide
CGSSEFPCHGTDICLPQRWLCDGVDDCGDDSDEENCEGTERT

SEQ ID NO: 28 - protein, 51 aa, Artificial Sequence
  Description of Artificial Sequence: Synthetic polypeptide
CGSSEFPCKGNDICLPPPWLCDGDNDCQDDSDETGCGDSHILPFSTPGPST

SEQ ID NO: 29 - protein, 44 aa, Artificial Sequence
  Description of Artificial Sequence: Synthetic polypeptide
CGSSEFPCQGSDICLPPPWLCDGDDDCEDGSDEPLANCAATEHT

SEQ ID NO: 30 - protein, 40 aa, Artificial Sequence
  Description of Artificial Sequence: Synthetic polypeptide
CGSSEFPCQGSDICLPPPWLCDGDDDCEDGSDETDCAPHT

SEQ ID NO: 31 - protein, 45 aa, Artificial Sequence
  Description of Artificial Sequence: Synthetic polypeptide
CGSSEFPCQGTDICIPQDWVCDGDDDCLDSSDEASCSQDPEFHKV

SEQ ID NO: 32 - protein, 49 aa, Artificial Sequence
  Description of Artificial Sequence: Synthetic polypeptide
CGSSEFPCQGTDICIPQTWLCDGDDDCEDSSDETNCGRPGPGATSAPAA

SEQ ID NO: 33 - protein, 40 aa, Artificial Sequence
  Description of Artificial Sequence: Synthetic polypeptide
CGSSEFPCQGTDICIPQTWLCDGDDDCQDGSDETDCAPHT

SEQ ID NO: 34 - protein, 47 aa, Artificial Sequence
  Description of Artificial Sequence: Synthetic polypeptide
CGSSEFPCQGTDICIPQTWLCDGDDDCQDGSDETSCSAPASEPPGSL

SEQ ID NO: 35 - protein, 51 aa, Artificial Sequence
  Description of Artificial Sequence: Synthetic polypeptide
CGSSEFPCQGTDICIPQTWLCDGDNDCVDNSDETGCGDSHILPFSTPGPST

SEQ ID NO: 36 - protein, 51 aa, Artificial Sequence
  Description of Artificial Sequence: Synthetic polypeptide
CGSSEFPCQGTDICIPQTWLCDGVDDCLDDSDEANCGDSHILPFSTPGPST

SEQ ID NO: 37 - protein, 42 aa, Artificial Sequence
  Description of Artificial Sequence: Synthetic polypeptide
CGSSEFPCQGTDICLPQHWLCDGEDDCGDDSDEPPAHCEEPT

SEQ ID NO: 38 - protein, 42 aa, Artificial Sequence
  Description of Artificial Sequence: Synthetic polypeptide
CGSSEFPCQGTDICLSPAWRCDGDDDCLDNSDEASCKAPVHT

SEQ ID NO: 39 - protein, 45 aa, Artificial Sequence
  Description of Artificial Sequence: Synthetic polypeptide
CGSSEFPCQGTDICLSPAWRCDGDDDCLDNSDEENCSQDPEFHKV

SEQ ID NO: 40 - protein, 47 aa, Artificial Sequence
  Description of Artificial Sequence: Synthetic polypeptide
CGSSEFPCRGNDICLPQRWLCDGENDCPDDSDETNCSAPASEPPGSL

SEQ ID NO: 41 - protein, 51 aa, Artificial Sequence
  Description of Artificial Sequence: Synthetic polypeptide
CGSSEFPCRGSDICLPQTWRCDGDNDCVDNSDETGCGDSHILPFSTPGPST

SEQ ID NO: 42 - protein, 47 aa, Artificial Sequence
  Description of Artificial Sequence: Synthetic polypeptide
CGSSEFPCRGTDICIPATWVCDGDNDCVDSSDEANCSAPASEPPGSL

SEQ ID NO: 43 - protein, 51 aa, Artificial Sequence
  Description of Artificial Sequence: Synthetic polypeptide
CGSSEFPCRGTDICISERWVCDGENDCLDDSDEEGCGDSHILPFSTPGPST

SEQ ID NO: 44 - protein, 51 aa, Artificial Sequence
  Description of Artificial Sequence: Synthetic polypeptide
CGSSQFPCRGTDICLSERWVCDGENDCLDDSDEKGCADSHILPFSTPCAST

SEQ ID NO: 45 - protein, 40 aa, Artificial Sequence
  Description of Artificial Sequence: Synthetic polypeptide
CGSSEFPCRGTDICLSWRCDGVPDCEDDSDEALAHCTART

SEQ ID NO: 46 - protein, 47 aa, Artificial Sequence
  Description of Artificial Sequence: Synthetic polypeptide
CGSSEFPCRGTDICLSWRCDGVPDCEDDSDEALDHCSAPASEPPGSL

SEQ ID NO: 47 - protein, 42 aa, Artificial Sequence
  Description of Artificial Sequence: Synthetic polypeptide
CGSSEFPCRGYDICISPAWLCDGDPDCVDDSDEANCGTPEHT

SEQ ID NO: 48 - protein, 42 aa, Artificial Sequence
  Description of Artificial Sequence: Synthetic polypeptide
CGSSEFPCSGTDICIPQGWLCDGDDDCRDDSDEAPELCEQRT

SEQ ID NO: 49 - protein, 42 aa, Artificial Sequence
  Description of Artificial Sequence: Synthetic polypeptide
CGSSEFPCSGYDICLPQQWGCDGVDDCPDDSDEADCGSTVHT

SEQ ID NO: 50 - protein, 47 aa, Artificial Sequence
  Description of Artificial Sequence: Synthetic polypeptide
CGSSQFPCKGTDICLSQRWVCDGEDDCVDGSDEEGCSAPASEPPGSL

SEQ ID NO: 51 - protein, 47 aa, Artificial Sequence
  Description of Artificial Sequence: Synthetic polypeptide
CLSNEFTCRNYNICIPQDWVCDGENDCVDNSDEADCSAPASEPPGSL

SEQ ID NO: 52 - protein, 47 aa, Artificial Sequence
  Description of Artificial Sequence: Synthetic polypeptide
CLSSEFTCRSYDKCVPPAWVCDGVLDCVDGSDETGCSAPASEPPGSL

SEQ ID NO: 53 - protein, 41 aa, Artificial Sequence
  Description of Artificial Sequence: Synthetic polypeptide
CPAFTEFLCKESNRCYPSEWRCDGEMDCADGSDELHCAYHT

SEQ ID NO: 54 - protein, 41 aa, Artificial Sequence
  Description of Artificial Sequence: Synthetic polypeptide
CPAGAFMCRNTTHCVSREMVCDGVPDCPDGSDEIAHCPYRT

SEQ ID NO: 55 - protein, 47 aa, Artificial Sequence
  Description of Artificial Sequence: Synthetic polypeptide
CAPNQFRCNSYDKCVPAHWVCDGVLDCLDSSDETNCSAPASEPPGSL

SEQ ID NO: 56 - protein, 44 aa, Artificial Sequence
  Description of Artificial Sequence: Synthetic polypeptide
CGSSEFPCHGSDICLSGPLVCDGDDDCQDNSDESLDHCAAPEPT

SEQ ID NO: 57 - protein, 40 aa, Artificial Sequence
  Description of Artificial Sequence: Synthetic polypeptide
CGSSEFPCHGTDICLPQRWGCDGVDDCLDGSDEASCKERT

SEQ ID NO: 58 - protein, 43 aa, Artificial Sequence
  Description of Artificial Sequence: Synthetic polypeptide
CGSSEFPCRGSDICLPPRWLCDGEDDCPDGSDESELCRTSVRT

SEQ ID NO: 59 - protein, 50 aa, Artificial Sequence
  Description of Artificial Sequence: Synthetic polypeptide
CGSSEFPCRGTDICIPEEWLCDGDNDCGDGSDEPPLCGRPGPGATSAPAA

SEQ ID NO: 60 - protein, 51 aa, Artificial Sequence
  Description of Artificial Sequence: Synthetic polypeptide
CGSSQFPCQDTDICIPAAWVCDGVIDCLDNSDETNCGDSHILPFSTPGPST

SEQ ID NO: 61 - protein, 41 aa, Artificial Sequence
  Description of Artificial Sequence: Synthetic polypeptide
CVPNEFPCALGGCATSFWTCDGYLDCLDTSDEEACEAPVPT

SEQ ID NO: 62 - protein, 51 aa, Artificial Sequence
  Description of Artificial Sequence: Synthetic polypeptide
CVSSQFQCRGYNKCLPAAWVCDGVIDCLDNSDETNCGDSHILPFSTPGPST

SEQ ID NO: 63 - protein, 51 aa, Artificial Sequence
  Description of Artificial Sequence: Synthetic polypeptide
CVSSQFQCRGYNKCLPAAWVCDGVIDCLDNSDETNCGDSHILPFSTSGPST

SEQ ID NO: 64 - protein, 48 aa, Artificial Sequence
  Description of Artificial Sequence: Synthetic polypeptide
CWANEFHCASGACIPVLWVCDGFIDCLDSSDESFASCSAPASEPPGSL

SEQ ID NO: 65 - protein, 48 aa, Artificial Sequence
  Description of Artificial Sequence: Synthetic polypeptide
CWLEVFKCTAGACSFTMMACDGDLDCWDWSDESLPFCSAPASEPPGSL

SEQ ID NO: 66 - protein, 43 aa, Artificial Sequence
  Description of Artificial Sequence: Synthetic polypeptide
SDVDECVILPGPCELDCVNTFDGYLCHCAPGFGGRLCVGGGGS

SEQ ID NO: 67 - protein, 45 aa, Artificial Sequence
  Description of Artificial Sequence: Synthetic polypeptide
SDVDECVPNPCPLVCVNTPGGFSCFCEPGFLPPDGAPACIGGGGS

SEQ ID NO: 68 - protein, 47 aa, Artificial Sequence
  Description of Artificial Sequence: Synthetic polypeptide
SDVGECILHPGPCELVCVNTPDGYICHCAPGFESPDSTNDCQAVEIS

SEQ ID NO: 69 - protein, 45 aa, Artificial Sequence
  Description of Artificial Sequence: Synthetic polypeptide
CAPGEFQCHSYNKCVPPTWVCDGILDCMDSSDEANCSQDPEFHKV

SEQ ID NO: 70 - protein, 45 aa, Artificial Sequence
  Description of Artificial Sequence: Synthetic polypeptide
CDPGAFQCHSYNKCVPPAWVCDGVLDCLDSSDEANCSQDPEFHKV

SEQ ID NO: 71 - protein, 45 aa, Artificial Sequence
  Description of Artificial Sequence: Synthetic polypeptide
CEMGQFQCHSYNKCVPAIWVCDGILDCLDSSDEANCSQDPEFHKV

SEQ ID NO: 72 - protein, 45 aa, Artificial Sequence
  Description of Artificial Sequence: Synthetic polypeptide
CEPDHFQCHSYLKCVPPTWVCDGVLDCLDSSDEANCSQDPEFHKV

SEQ ID NO: 73 - protein, 45 aa, Artificial Sequence
  Description of Artificial Sequence: Synthetic polypeptide
CEPGEFLCHSYNKCVPPAWVCDGVLDCVDSSDEANCSQDPEFHKV

SEQ ID NO: 74 - protein, 45 aa, Artificial Sequence
  Description of Artificial Sequence: Synthetic polypeptide
CEPGEFQCHSYDKCVPPSWVCDGVLDCLDSSDEANCSQDPEFHKV

SEQ ID NO: 75 - protein, 45 aa, Artificial Sequence
  Description of Artificial Sequence: Synthetic polypeptide
CEPGEFQCHSYNKCVPATWVCDGILDCLDSSDEAYCSQDPEFHKV

SEQ ID NO: 76 - protein, 45 aa, Artificial Sequence
  Description of Artificial Sequence: Synthetic polypeptide
CEPGEFQCHSYNKCVPPTWVCDGVLDCLDSSDEANCSQDPEFHKV

SEQ ID NO: 77 - protein, 45 aa, Artificial Sequence
  Description of Artificial Sequence: Synthetic polypeptide
CEPGEFQCHSYNKCVPTIWVCDGVLDCVDSSDEANCSQDPEFHKV

SEQ ID NO: 78 - protein, 45 aa, Artificial Sequence
  Description of Artificial Sequence: Synthetic polypeptide
CEPGEFQCQSYNKCVPPTWVCDGVLDCLDSSDEANCSQDPEFHKV

SEQ ID NO: 79 - protein, 45 aa, Artificial Sequence
  Description of Artificial Sequence: Synthetic polypeptide
CEPGHFQCHSYNKCVPLIWVCDGVLDCLDSSDEANCSQDPEFHKV

SEQ ID NO: 80 - protein, 45 aa, Artificial Sequence
  Description of Artificial Sequence: Synthetic polypeptide
CEPGHFQCHSYYKCVPPIWVCDGVLDCLDSSDEANCSQDPEFHKV

SEQ ID NO: 81 - protein, 45 aa, Artificial Sequence
  Description of Artificial Sequence: Synthetic polypeptide
CEPGHFQCQSYDKCVPPSWVCDGVLDCLDSSDEANCSQDPEFHKV

SEQ ID NO: 82 - protein, 45 aa, Artificial Sequence
  Description of Artificial Sequence: Synthetic polypeptide
CEPGQFLCHSYNKCVPASWVCDGVLDCMDSSDEVNCSQDPEFHKV

SEQ ID NO: 83 - protein, 45 aa, Artificial Sequence
  Description of Artificial Sequence: Synthetic polypeptide
CEPGQFQCHSYDKCVPPTWVCDGILDCLDSSDEANCSQDPEFHKV

SEQ ID NO: 84 - protein, 45 aa, Artificial Sequence
  Description of Artificial Sequence: Synthetic polypeptide
CEPGQFQCHSYFKCVPPTWVCDGVLDCLDSSDEANCSQDPEFHKV

SEQ ID NO: 85 - protein, 45 aa, Artificial Sequence
  Description of Artificial Sequence: Synthetic polypeptide
CEPGQFQCHSYHKCVPPIWVCDGVLDCLDSSDEANCSQDPEFHKV

SEQ ID NO: 86 - protein, 45 aa, Artificial Sequence
  Description of Artificial Sequence: Synthetic polypeptide
CEPGQFQCHSYNKCVPPAWICDGVLDCLDSSDEANCSQDPEFHKV

SEQ ID NO: 87 - protein, 45 aa, Artificial Sequence
  Description of Artificial Sequence: Synthetic polypeptide
CEPGQFQCHSYNKCVPPVWVCDGVLDCLDSSDEANCSQDPEFHKV

SEQ ID NO: 88 - protein, 45 aa, Artificial Sequence
  Description of Artificial Sequence: Synthetic polypeptide
CEPGQFQCLTYDKCVPPIWVCDGVLDCMDSSDEANCSQDPEFHKV

SEQ ID NO: 89 - protein, 45 aa, Artificial Sequence
  Description of Artificial Sequence: Synthetic polypeptide
CEPGQFQCYSYNKCVPPTWVCDGVLDCLDSSDEANCSQDPEFHKV

SEQ ID NO: 90 - protein, 45 aa, Artificial Sequence
  Description of Artificial Sequence: Synthetic polypeptide
CEPGWFQCHSYNKCVRSDWVCDGVLDCLDSSDEANCSQDPEFHKV

SEQ ID NO: 91 - protein, 45 aa, Artificial Sequence
  Description of Artificial Sequence: Synthetic polypeptide
CEPGYFQCHSYYKCVPPTWVCDGVLDCLDSSDEANCSQDPEFHKV

SEQ ID NO: 92 - protein, 45 aa, Artificial Sequence
  Description of Artificial Sequence: Synthetic polypeptide
CEPSEFQCQSYDKCVPPIWVCDGVLDCVDSSDEANCSQDPEFHKV

SEQ ID NO: 93 - protein, 45 aa, Artificial Sequence
  Description of Artificial Sequence: Synthetic polypeptide
CEPSQFQCHSYHKCVRPTWVCDGVLDCLDSSDEANCSQDPEFHKV

SEQ ID NO: 94 - protein, 45 aa, Artificial Sequence
  Description of Artificial Sequence: Synthetic polypeptide
CEQGEFECHSYTKCVPPTWVCDGVLDCLDSSDETNCSQDPEFHKV

SEQ ID NO: 95 - protein, 45 aa, Artificial Sequence
  Description of Artificial Sequence: Synthetic polypeptide
CEQGEFQCHSYFKCVPPTWVCDGVLDCLDSSDEANCSQDPEFHKV

SEQ ID NO: 96 - protein, 45 aa, Artificial Sequence
  Description of Artificial Sequence: Synthetic polypeptide
CEQGQFQCHSYYKCVPPIWVCDGVLDCLDSSDEANCSQDPEFHKV

SEQ ID NO: 97 - protein, 45 aa, Artificial Sequence
  Description of Artificial Sequence: Synthetic polypeptide
CEQGYFQCHSYNKCVPPPWVCDGVLDCLDSSDEANCSQDPEFHKV

SEQ ID NO: 98 - protein, 45 aa, Artificial Sequence
  Description of Artificial Sequence: Synthetic polypeptide
CQPPEFQCQSYKKCVPPTWVCDGVLDCVDSSDETNCSQDPEFHKV

SEQ ID NO: 99 - protein, 41 aa, Artificial Sequence
  Description of Artificial Sequence: Synthetic polypeptide
CPAFTEFLCADSNRCYPSEWRCDGEMDCVDGSDEQNCAYHT

SEQ ID NO: 100 - protein, 41 aa, Artificial Sequence
  Description of Artificial Sequence: Synthetic polypeptide
CPAFTEFLCHDSSRCYPSEWRCDGEIDCADSSDELHCAYHT

SEQ ID NO: 101 - protein, 41 aa, Artificial Sequence
  Description of Artificial Sequence: Synthetic polypeptide
CPAFTEFLCKDSNRCYPSEWRCDGEIDCADRSDEQGCAYHT

SEQ ID NO: 102 - protein, 41 aa, Artificial Sequence
  Description of Artificial Sequence: Synthetic polypeptide
CPAFTEFLCKDSNRCYPSEWRCDGEVDCTDGSDELHCAYHT

SEQ ID NO: 103 - protein, 41 aa, Artificial Sequence
  Description of Artificial Sequence: Synthetic polypeptide
CPAFTEFLCKDSQRCYPTEWRCDGEIDCADGSDEHHCAYHT

SEQ ID NO: 104 - protein, 41 aa, Artificial Sequence
  Description of Artificial Sequence: Synthetic polypeptide
CPAFTEFLCQDSNRCYPSEWRCDGEMDCVDASDEHLCAYHT

SEQ ID NO: 105 - protein, 41 aa, Artificial Sequence
  Description of Artificial Sequence: Synthetic polypeptide
CPAFTEFLCRDSNRCYPSEWRCDGEIDCADASDELHCAYHT

SEQ ID NO: 106 - protein, 41 aa, Artificial Sequence
  Description of Artificial Sequence: Synthetic polypeptide
CPAFTEFLCTDSNRCYPSEWRCDGEIDCSDDSDEQDCAYHT

SEQ ID NO: 107 - protein, 41 aa, Artificial Sequence
  Description of Artificial Sequence: Synthetic polypeptide
CPAYTEFLCKDSDRCFPSEWRCDGEMDCVDGSDELHCAYHT

SEQ ID NO: 108 - protein, 41 aa, Artificial Sequence
  Description of Artificial Sequence: Synthetic polypeptide
CPAYTEFLCKDSDRCYPSEWRCDGEMDCADNSDEVHCAYHT

SEQ ID NO: 109 - protein, 41 aa, Artificial Sequence
  Description of Artificial Sequence: Synthetic polypeptide
CHTFADFMCQETYRCHPQGGRCDGEMDCSDDSDEVHCAYHT

SEQ ID NO: 110 - protein, 41 aa, Artificial Sequence
  Description of Artificial Sequence: Synthetic polypeptide
CPAYTEFLCKNSNRCFPSEWRCDGEIDCADGSDELHCAYHT

SEQ ID NO: 111 - protein, 41 aa, Artificial Sequence
  Description of Artificial Sequence: Synthetic polypeptide
CPAFTEFLCADSNRCYPSEWRCDGEIDCADASDERHCAYHT

SEQ ID NO: 112 - protein, 41 aa, Artificial Sequence
  Description of Artificial Sequence: Synthetic polypeptide
CPAGAFMCWNDTHCVSREMVCDGVTDCPDGSDEIFHCPYRT

SEQ ID NO: 113 - protein, 41 aa, Artificial Sequence
  Description of Artificial Sequence: Synthetic polypeptide
CPAGAFMCWNTTHCVSREMVCDGITDCPDGSDELFHCPYRT

SEQ ID NO: 114 - protein, 41 aa, Artificial Sequence
  Description of Artificial Sequence: Synthetic polypeptide
CPGGAFMCRNTTHCLGPELVCDGVPDCPDGSDETAHCPYRT

SEQ ID NO: 115 - protein, 108 aa, Artificial Sequence
  Description of Artificial Sequence: Synthetic polypeptide
CPPGAFMCWNATHCVSWEMVCDGVPDCPDGSDEIAYCPYRTSLQKASAAYPYDVPDYAPGLEASGGSCQAGAFICRNTTHCVSRKMVCDGVPDCPDGSDEIAQCPYRT

SEQ ID NO: 116 - protein, 41 aa, Artificial Sequence
  Description of Artificial Sequence: Synthetic polypeptide
CPSGAFMCWNTTHCVSPEMVCDGVDDCPDGSDEIFHCPYRT

SEQ ID NO: 117 - protein, 41 aa, Artificial Sequence
  Description of Artificial Sequence: Synthetic polypeptide
CPTGAFTCWNTTHCVSREMVCDGVDDCPDGSDEIFHCPYRT

SEQ ID NO: 118 - protein, 45 aa, Artificial Sequence
  Description of Artificial Sequence: Synthetic polypeptide
CGSIEFPCEGTDICLSEVWRCDGDDDCLDYSDEANCSQDPEFHKV

SEQ ID NO: 119 - protein, 45 aa, Artificial Sequence
  Description of Artificial Sequence: Synthetic polypeptide
CGSIEFPCMGPDICLSPAWLCDGDDDCLDNSDEAYCSQDPEFHKV

SEQ ID NO: 120 - protein, 45 aa, Artificial Sequence
  Description of Artificial Sequence: Synthetic polypeptide
CGSIEFPCQGTDICLAPEWMCDGDDDCLDNSDEAYCSQDPEFHKV

SEQ ID NO: 121 - protein, 45 aa, Artificial Sequence
  Description of Artificial Sequence: Synthetic polypeptide
CGSLEFPCQGPDICLLPAWQCDGDDDCLDYSDETNCSQDPEFHKV

SEQ ID NO: 122 - protein, 45 aa, Artificial Sequence
  Description of Artificial Sequence: Synthetic polypeptide
CGSNEFPCQGSDICLAPEWLCDGDDDCLDFSDEAYCSQDPEFHKV

SEQ ID NO: 123 - protein, 45 aa, Artificial Sequence
  Description of Artificial Sequence: Synthetic polypeptide
CGSREFPCLGTDICLLPAWLCDGDDDCLDRSDEVNCSQDPEFHKV

SEQ ID NO: 124 - protein, 45 aa, Artificial Sequence
  Description of Artificial Sequence: Synthetic polypeptide
CGSREFPCQGPDICLLPAWLCDGDDDCLDYSDEEDCSQDPEFHKV

SEQ ID NO: 125 - protein, 45 aa, Artificial Sequence
  Description of Artificial Sequence: Synthetic polypeptide
CGSREFPCQGPDICLLPEWLCDGDDDCLDNSDEAYCSQDPEFHKV

SEQ ID NO: 126 - protein, 45 aa, Artificial Sequence
  Description of Artificial Sequence: Synthetic polypeptide
CGSREFPCQGPDICLSPEWLCDGDDDCMDNSDEDDCSQDPEFHKV

SEQ ID NO: 127 - protein, 45 aa, Artificial Sequence
  Description of Artificial Sequence: Synthetic polypeptide
CGSREFPCQGTDICLPPEWICDGDDNCLDTSDEAYCSQDPEFHKV

SEQ ID NO: 128 - protein, 99 aa, Artificial Sequence
  Description of Artificial Sequence: Synthetic polypeptide
CGSREFPCQGTDICLSPLWRCDGEEDCLDNSDEGNCSQDPEFHKVSLLEASGGSCGSSEFSCHSTDICLSPAWRCDGDDDCLDNSDEANCSQDPEFHKV

SEQ ID NO: 129 - protein, 45 aa, Artificial Sequence
  Description of Artificial Sequence: Synthetic polypeptide
CGSSDFPCWGPDICLSPAWLCDGDDDCLDYSDETDCSQDPEFHKV

SEQ ID NO: 130 - protein, 45 aa, Artificial Sequence
  Description of Artificial Sequence: Synthetic polypeptide
CGSSEFPCHGTDICLAPEWYCDGDDDCLDDSDESYCSQDLEFHKV

SEQ ID NO: 131 - protein, 45 aa, Artificial Sequence
  Description of Artificial Sequence: Synthetic polypeptide
CGSSEFPCQGADICLLPAWSCDGDDDCQDYSDETNCSQDPEFHKV

SEQ ID NO: 132 - protein, 45 aa, Artificial Sequence
  Description of Artificial Sequence: Synthetic polypeptide
CGSSEFPCQGPDICLSPAWLCDGDDDCLDYSDEPDCSQDPEFHKV

SEQ ID NO: 133 - protein, 45 aa, Artificial Sequence
  Description of Artificial Sequence: Synthetic polypeptide
CGSSEFPCQGSDICLAPEWLCDGDDDCLDFSDEAYCSQDPEFHKV

SEQ ID NO: 134 - protein, 45 aa, Artificial Sequence
  Description of Artificial Sequence: Synthetic polypeptide
CGSSEFPCQGTDICLLPAWLCDGDDDCLDESDEAYCSQDPEFHKV

SEQ ID NO: 135 - protein, 45 aa, Artificial Sequence
  Description of Artificial Sequence: Synthetic polypeptide
CGSSEFPCQGTDICLLPEWLCDGDDDCLDDSDESYCSQDPEFHKV

SEQ ID NO: 136 - protein, 45 aa, Artificial Sequence
  Description of Artificial Sequence: Synthetic polypeptide
CGSSEFPCQGTDICLPPAWLCDGDDDCLDNSDEANCSQDPEFHKV

SEQ ID NO: 137 - protein, 45 aa, Artificial Sequence
  Description of Artificial Sequence: Synthetic polypeptide
CGSSEFPCQGTDICLPPSWLCDGDDDCLDTSDEAYCSQDPEFHKV

SEQ ID NO: 138 - protein, 45 aa, Artificial Sequence
  Description of Artificial Sequence: Synthetic polypeptide
CGSYDFPCQGSDICLPPAWSCDGDDDCLDYSDETYCSQDPEFHKV

SEQ ID NO: 139 - protein, 45 aa, Artificial Sequence
  Description of Artificial Sequence: Synthetic polypeptide
CGSYEFPCQGTDICLLPAWLCDGDADCRDYSDETDCSQDPEFHKV

SEQ ID NO: 140 - protein, 45 aa, Artificial Sequence
  Description of Artificial Sequence: Synthetic polypeptide
CGTSEFPCQGTDICLLPAWLCDGDDDCLDDSDEAYCSQDPEFHKV

SEQ ID NO: 141 - protein, 45 aa, Artificial Sequence
  Description of Artificial Sequence: Synthetic polypeptide
CGSREFPCQGTDICLPPAWLCDGDDDCLDNPDEAYCSQDPEFHKV

SEQ ID NO: 142 - protein, 47 aa, Artificial Sequence
  Description of Artificial Sequence: Synthetic polypeptide
CAPNEFRCNSYDKCVPEHWVCDGVLDCLDSSDETNCSAPASEPPGSL

SEQ ID NO: 143 - protein, 47 aa, Artificial Sequence
  Description of Artificial Sequence: Synthetic polypeptide
CAPNQFMCVSYDKCVPAHWVCDGVLDCLDSSDETNCSAPASEPPGSL

SEQ ID NO: 144 - protein, 47 aa, Artificial Sequence
  Description of Artificial Sequence: Synthetic polypeptide
CEPNEFRCNSYDKCVPAHWVCDGVLDCLDSSDETDCSAPASEPPGSL

SEQ ID NO: 145 - protein, 47 aa, Artificial Sequence
  Description of Artificial Sequence: Synthetic polypeptide
CEPNQFLCKSYDKCVPEHWVCDGVLDCLDSSDETNCSAPASEPPGSL

SEQ ID NO: 146 - protein, 47 aa, Artificial Sequence
  Description of Artificial Sequence: Synthetic polypeptide
CGRDHFRCRSYDKCVPAHWLCDGVLDCLDSSDETYCSAPASEPPGSL

SEQ ID NO: 147 - protein, 47 aa, Artificial Sequence
  Description of Artificial Sequence: Synthetic polypeptide
CSADQFKCNSYDKCVPAHWVCDGVLDCLDSSDETNCSAPASEPPGSL

SEQ ID NO: 148 - protein, 47 aa, Artificial Sequence
  Description of Artificial Sequence: Synthetic polypeptide
CSENQFRCISYDKCVPVHWVCDGVLDCLDSSDETNCSAPASEPPGSL

SEQ ID NO: 149 - protein, 43 aa, Artificial Sequence
  Description of Artificial Sequence: Synthetic polypeptide
SDVDECFILPGPCELDCVNTFDGYLCDCAPSFGGRLCVGGGGS

SEQ ID NO: 150 - protein, 43 aa, Artificial Sequence
  Description of Artificial Sequence: Synthetic polypeptide
SDVDECFILPGPCELDCVNTFDGYLCHCAPGFGGRLCVGGGGS

SEQ ID NO: 151 - protein, 43 aa, Artificial Sequence
  Description of Artificial Sequence: Synthetic polypeptide
SDVDECFILPGPCELDCVNTFDGYLCHCAPGFGSRLCVGGGGS

SEQ ID NO: 152 - protein, 43 aa, Artificial Sequence
  Description of Artificial Sequence: Synthetic polypeptide
SDVDECIILPGPCELDCMYTFDGYLCDCAPSFGGRLCVGGGGS

SEQ ID NO: 153 - protein, 43 aa, Artificial Sequence
  Description of Artificial Sequence: Synthetic polypeptide
SDVDECIILPGPCELECVNTFDGYLCHCKPTFGGRLCVGGGGS

SEQ ID NO: 154 - protein, 43 aa, Artificial Sequence
  Description of Artificial Sequence: Synthetic polypeptide
SDVDECVELPGPCELDCVNTFDGYICDCAPSFGGRLCVGGGGS

SEQ ID NO: 155 - protein, 43 aa, Artificial Sequence
  Description of Artificial Sequence: Synthetic polypeptide
SDVDECVILPGPCELDCVDTFDGYLCHCAPSFGGRLCVGGGGS

SEQ ID NO: 156 - protein, 43 aa, Artificial Sequence
  Description of Artificial Sequence: Synthetic polypeptide
SDVDECVILPGPCELDCVNTFDDYVCHCKPSFGGVLCVGGGGS

SEQ ID NO: 157 - protein, 43 aa, Artificial Sequence
  Description of Artificial Sequence: Synthetic polypeptide
SDVDECVILPGPCELDCVNTFDGYLCHCAPSFGGRLCVGGGGS

SEQ ID NO: 158 - protein, 43 aa, Artificial Sequence
  Description of Artificial Sequence: Synthetic polypeptide
SDVDECVILPGPCELDCVNTIDGYICHCAPSFGGRLCVGGGGS

SEQ ID NO: 159 - protein, 43 aa, Artificial Sequence
  Description of Artificial Sequence: Synthetic polypeptide
SDVDECVILPGPCELDCVNTLDDYLCHCAPSFGGQLCVGGGGS

SEQ ID NO: 160 - protein, 43 aa, Artificial Sequence
  Description of Artificial Sequence: Synthetic polypeptide
SDVDECVILPGPCELECVNTFDGYLCDCAPSFGGRLCVGGGGS

SEQ ID NO: 161 - protein, 43 aa, Artificial Sequence
  Description of Artificial Sequence: Synthetic polypeptide
SDVDECVILPGPCELECVNTFDGYLCHCAPSFGGRLCVGGGGS

SEQ ID NO: 162 - protein, 43 aa, Artificial Sequence
  Description of Artificial Sequence: Synthetic polypeptide
SDVDECVILPGPCELECVNTFDGYMCHCAPSFGGRLCVGGGGS

SEQ ID NO: 163 - protein, 43 aa, Artificial Sequence
  Description of Artificial Sequence: Synthetic polypeptide
SDVDECVTLPGPCELDCVNTLDGYLCSCAPSFGGPLCVGGGGS

SEQ ID NO: 164 - protein, 43 aa, Artificial Sequence
  Description of Artificial Sequence: Synthetic polypeptide
SDVDECLILPGPCELDCVNTFDGYLCDCAPSFGGRLCVGGGGS

SEQ ID NO: 165 - protein, 43 aa, Artificial Sequence
  Description of Artificial Sequence: Synthetic polypeptide
SDVDECFILPGPCELDCVDTFDGYLCHCAPSFGGRLCVGGGGS

SEQ ID NO: 166 - protein, 82 aa, Artificial Sequence
  Description of Artificial Sequence: Synthetic polypeptide
CPAFTEFLCKDSNRCYPSEWRCDGEVDCTDGSDELHCAYHTCPAGEFQCGNGRCIPQGWLCDGENDCPDNSDEANCTAPART

SEQ ID NO: 167 - protein, 90 aa, Artificial Sequence
  Description of Artificial Sequence: Synthetic polypeptide
CLPGEFQCSSGSCIPQQWLCDGVNDCQDNSDESLDHCGAPVPTCAPNQFRCNSYDKCVPAHWVCDGVLDCLDSSDETNCSAPASEPPGSL

SEQ ID NO: 168 - protein, 89 aa, Artificial Sequence
  Description of Artificial Sequence: Synthetic polypeptide
CEPGEFKCQSSGICIPEAWVCDGVNDCEDNSDEPPEHCPTHTCAPNQFRCNSYDKCVPAHWVCDGVLDCLDSSDETNCSAPASEPPGSL

SEQ ID NO: 169 - protein, 90 aa, Artificial Sequence
  Description of Artificial Sequence: Synthetic polypeptide
CLANEFRCDSGRCISLDWVCDGVNDCEDGSDESLETCEAPGHTCAPNQFRCNSYDKCVPAHWVCDGVLDCLDSSDETNCSAPASEPPGSL

SEQ ID NO: 170 - protein, 88 aa, Artificial Sequence
  Description of Artificial Sequence: Synthetic polypeptide
CLPSEFPCESGHCIPGNWVCDGVNDCEDGSDEPLDHCPAHTCAPNQFRCNSYDKCVPAHWVCDGVLDCLDSSDETNCSAPASEPPGSL

SEQ ID NO: 171 - protein, 89 aa, Artificial Sequence
  Description of Artificial Sequence: Synthetic polypeptide
CLSNEFQCSSGRCIPASWRCDGVNDCGDGSDEAGCGRPGPGATSAPAACPAFTEFLCKDSNRCYPSEWRCDGEVDCTDGSDELHCAYHT

SEQ ID NO: 172 - protein, 92 aa, Artificial Sequence
  Description of Artificial Sequence: Synthetic polypeptide
SDVDECQIDPGPCYSGGTCVNTEDGFNCYCLPGFKGHDCEEPILSCAPNQFRCNSYDKCVPAHWVCDGVLDCLDSSDETNCSAPASEPPGSL

SEQ ID NO: 173 - protein, 95 aa, Artificial Sequence
  Description of Artificial Sequence: Synthetic polypeptide
SDVDECRLPGPCRRGGTCVNAADGFYCDCTPGFDYNYNTNSCEEEVISCAPNQFRCNSYDKCVPAHWVCDGVLDCLDSSDETNCSAPASEPPGSL

SEQ ID NO: 174 - protein, 90 aa, Artificial Sequence
  Description of Artificial Sequence: Synthetic polypeptide
SDVDECVILPGPCELDCVNTFDGYLCHCVPGFNGLNCQGGGGSCAPNQFRCNSYDKCVPAHWVCDGFLDCLDSSDETNCTAPASEPPGSL

SEQ ID NO: 175 - protein, 92 aa, Artificial Sequence
  Description of Artificial Sequence: Synthetic polypeptide
SDVDECRPNPCDHGCVNTASGYSCRCQPGFAPSDDTSDCEIALISCAPNQFRCNSYDKCVPAHWVCDGVLDCLDSSDETNCSAPASEPPGSL

SEQ ID NO: 176 - protein, 94 aa, Artificial Sequence
  Description of Artificial Sequence: Synthetic polypeptide
SDVDECLANPCHPGGTCVNTYSSYQCLCQSGFQSPADTSACEIAIHSCAPNQFRCNSYDKCVPAHWVCDGVLDCLDSSDETNCSAPASEPPGSL

SEQ ID NO: 177 - protein, 95 aa, Artificial Sequence
  Description of Artificial Sequence: Synthetic polypeptide
CPSNQFPCESGQCIPLAWVCDGVNDCQDSSDEEDCGDSHILPFSTPGPSTCGSREFPCQGTDICLPPEWICDGDDDCLETSDEAYCSQDPEFHKV

SEQ ID NO: 178 - protein, 95 aa, Artificial Sequence
  Description of Artificial Sequence: Synthetic polypeptide
CASSEFQCNNGRCIPANWVCDGVPDCQDGSDEEDCGDSHILPFSTPGPSTCGSREFPCQGTDICLPPEWICDGDDDCLDTPDEAYCSQDPEFHKV

SEQ ID NO: 179 - protein, 86 aa, Artificial Sequence
  Description of Artificial Sequence: Synthetic polypeptide
CRASEFRCRSGRCIPATWLCDGEDDCADGSDEKDCKAPEPTCGSREFPCQGTDICLPPEWICDGDDDCLDTSDEAYCSQDPEFHKV

SEQ ID NO: 180 - protein, 84 aa, Artificial Sequence
  Description of Artificial Sequence: Synthetic polypeptide
CPADEFPCNSGRCIPLAWVCDGENDCGDDSDETSCPTPTCGSREFPCQGTDICLPPEWICDGDDDCLDTPDEAYCSQDPEFHKV

SEQ ID NO: 181 - protein, 87 aa, Artificial Sequence
  Description of Artificial Sequence: Synthetic polypeptide
CAAGQFQCQSYGRCIPPDWVCDGENDCGDDSDEESCETTEPTCGSREFPCQGTDICLPPEWICDGDDDCLDTPDEAYCSQDPEFHKV

SEQ ID NO: 182 - protein, 87 aa, Artificial Sequence
  Description of Artificial Sequence: Synthetic polypeptide
CQSDQFPCGNGHCIPVQWVCDGVNDCGDGSDESEHCTAPAHTCGSREFPCQGTDICLPPEWICDGDDDCLDTSDEAYCSQDPEFHKV

SEQ ID NO: 183 - protein, 89 aa, Artificial Sequence
  Description of Artificial Sequence: Synthetic polypeptide
CLASQFQCGNGHCIPQHWLCDGVDDCVDGSDEADCSQDPEFHKVCGSREFPCQGTDICLPPAWLCDGDDDCLDTPDEAYCSQDPEFHKV

SEQ ID NO: 184 - protein, 90 aa, Artificial Sequence
  Description of Artificial Sequence: Synthetic polypeptide
CPSDQFPCGNGHCIPRRWLCDGVNDCGDGSDEPEQCSQDPEFHKVCGSREFPCQGTDICLPPAWLCDGDDDCLDNPDEAYCSQDPEFHKV

SEQ ID NO: 185 - protein, 88 aa, Artificial Sequence
  Description of Artificial Sequence: Synthetic polypeptide
CPSSEFTCESGKCVPPEWGCDGVDDCGDSSDEPPANCAAPGHTCGSREFPCQGTDICLPPEWICDGDDDCLDTPDEAYCSQDPEFHKV

SEQ ID NO: 186 - protein, 90 aa, Artificial Sequence
  Description of Artificial Sequence: Synthetic polypeptide
CRSSQFQCGSGHCIPETWLCDGENDCRDGSDEPEVCSQDPEFHKVCGSREFPCQGTDICLPPEWICDGDDDCLETSDEAYCSQDPEFHKV

SEQ ID NO: 187 - protein, 87 aa, Artificial Sequence
  Description of Artificial Sequence: Synthetic polypeptide
CPPSQFRCKSGRCIPEHWVCDGENDCGDGSDESQHCGRAAPTCGSREFPCQGTDICLPPAWLCDGDDDCLDNPDEAYCSQDPEFHKV

SEQ ID NO: 188 - protein, 87 aa, Artificial Sequence
  Description of Artificial Sequence: Synthetic polypeptide
CPSGQFTCGSGNCIPRTWLCDGVNDCGDGSDEAPLCKRAVPTCGSREFPCQGTDICLPPAWLCDGDDDCLDTPDEAYCSQDPEFHKV

SEQ ID NO: 189 - protein, 87 aa, Artificial Sequence
  Description of Artificial Sequence: Synthetic polypeptide
CAASQFQCGSGHCVPVGWLCDGVNDCADGSDESALCKAAAPTCGSREFPCQGTDICLPPEWICDGDDDCLDTSDEAYCSQDPEFHKV

SEQ ID NO: 190 - protein, 92 aa, Artificial Sequence
  Description of Artificial Sequence: Synthetic polypeptide
CRSSQFQCGSGQCISGRWVCDGVDDCGDGSDESPLCSAPASEPPGSLCGSREFPCQGTDICLPPAWLCDGDDDCLDTPDEAYCSQDPEFHKV

SEQ ID NO: 191 - protein, 90 aa, Artificial Sequence
  Description of Artificial Sequence: Synthetic polypeptide
CPSSQFQCSSSDICISAPWLCDGVNDCGDNSDEADCSQDPEFHKVCGSREFPCQGTDICLPPAWLCGGDDDCLDNPDEAYCSQDPEFHKV

SEQ ID NO: 192 - protein, 93 aa, Artificial Sequence
  Description of Artificial Sequence: Synthetic polypeptide
CRPNEFTCRSGRCIPPNWVCDGDNDCADDSDEAGCGRPGPGATSAPAACGSREFPCQGTDICLPPEWICDGDDDCLDTPDEAYCSQDPEFHKV

SEQ ID NO: 193 - protein, 91 aa, Artificial Sequence
  Description of Artificial Sequence: Synthetic polypeptide
CGSREFPCQGTDICLPPAWLCDGDDDCLDTPDEAYCSQDPEFHKVCGPNQFQCHSNKTCIPRPWVCDGENDCGDGSDESPHCSQDPEFHKV

SEQ ID NO: 194 - protein, 87 aa, Artificial Sequence
  Description of Artificial Sequence: Synthetic polypeptide
CAPSQFQCGSGQCIPEEWLCDGEPDCPDGSDEPALCTGPEPTCGSREFPCQGTDICLPPEWICDGDDDCLDTSDEAYCSQDPEFHKV

SEQ ID NO: 195 - protein, 83 aa, Artificial Sequence
  Description of Artificial Sequence: Synthetic polypeptide
CQATAEFECRSGRCIPLGWVCDGEDDCGDSSDETGCEGSAPTCPGGAFMCRNTTHCLGPELVCDGVPDCPDGSDETAHCPYRT

SEQ ID NO: 196 - protein, 91 aa, Artificial Sequence
  Description of Artificial Sequence: Synthetic polypeptide
RPPGQFTCSSGNCISAGWLCDGEDDCLDGSDETGCSAPASEPPGSLCEPGQFQCHSYNKCVPPVWVCDGVLDCLDSSDEANCSQDPEFHKV

SEQ ID NO: 197 - protein, 91 aa, Artificial Sequence
  Description of Artificial Sequence: Synthetic polypeptide
CAPDEFKCSNGKCIPPQWGCDGDNDCGDNSDEANCSAPASEPPGSLCQPGQFQCHSYPKCVPPIWVCDGVLDCLDSSDEADCSQDPEFHRV

SEQ ID NO: 198 - protein, 92 aa, Artificial Sequence
  Description of Artificial Sequence: Synthetic polypeptide
CESSEFPCDNGRCLSLHWVCDGEDDCGDGSDEPPECSAPASEPPGSLCEPGHFQCHSYYKCVPPIWVCDGVLDCLDSSDEANCSQDPEFHKV

SEQ ID NO: 199 - protein, 84 aa, Artificial Sequence
  Description of Artificial Sequence: Synthetic polypeptide
CQSSQFQCNSGQCIPPEWLCDGVNDCQDDSDEADCPAPTCQPGQFQCHSYPKCVPPIWVCDGVLDCLDSSDEADCSQDPEFHKV

SEQ ID NO: 200 - protein, 87 aa, Artificial Sequence
  Description of Artificial Sequence: Synthetic polypeptide
CVSGQFTCSNGKCVPQAWLCDGENDCPDGSDESQLCGAPAHTCQPGQFQCHSYPKCVPPIWVCDGVLDCLDSSDEADCSQDPEFHKV

SEQ ID NO: 201 - protein, 86 aa, Artificial Sequence
  Description of Artificial Sequence: Synthetic polypeptide
CASNEFTCENGNCIPGNWLCDGVNDCRDDSDEPLETCATHTCEPGQFQCHSYNKCVPPIWVCDGVLDCLDSSDEANCSQDPEFHKV

SEQ ID NO: 202 - protein, 89 aa, Artificial Sequence
  Description of Artificial Sequence: Synthetic polypeptide
CQSGEFTCGNGSCVPGPLVCDGENDCRDSSDEESCSQDPEFHKVCQPGQFQCHSYPKCVPPIWVCDGVLDCLDSSDEADCSQDPEFHKV

SEQ ID NO: 203 - protein, 86 aa, Artificial Sequence
  Description of Artificial Sequence: Synthetic polypeptide
CESGEFKCNNGSCISAGWLCDGVDDCGDGSDESLENCQTPTCQPGQFQCHSYPKCVPPIWVCDGVLDCLDSSDEADCSQDPEFHKV

SEQ ID NO: 204 - protein, 84 aa, Artificial Sequence
  Description of Artificial Sequence: Synthetic polypeptide
CGASEFTCSSGRCIPLAWLCDGDDDCGDGSDESLATCTAAAPTCPGGAFMCRNTTHCLGPELVCDGVPDCPDGSDETAHCPYRT

SEQ ID NO: 205 - protein, 87 aa, Artificial Sequence
  Description of Artificial Sequence: Synthetic polypeptide
CLSDEFRCRSTGRCIPVTWLCDGVDDCEDSSDEPSDHCQKPTCEPGQFQCHSYNKCVPPVWVCDGVLDCLDSSDEADCSQDPEFHKV

SEQ ID NO: 206 - protein, 85 aa, Artificial Sequence
  Description of Artificial Sequence: Synthetic polypeptide
CEADQFKCGSGSCIPEAWLCDGDNDCGDGSDESAVCPKPTCQPGQFQCHSYPKCVPPIWVCDGVLDCLDSSDEADCSQDPEFHKV

SEQ ID NO: 207 - protein, 88 aa, Artificial Sequence
  Description of Artificial Sequence: Synthetic polypeptide
CLADQFRCDNGHCVPAALVCDGEDDCEDDSDESLAHCEAPAPTCQPGQFQCHSYPKCVPPIWVCDGVLDCLDSSDEADCSQDPEFHKV

SEQ ID NO: 208 - protein, 86 aa, Artificial Sequence
  Description of Artificial Sequence: Synthetic polypeptide
CVPSEFTCESGHCIPLGWLCDGDNDCEDSSDETSCAAPAPTCQPGQFQCHSYPKCVPPIWVCDGILDCLDSSDEADCSQDPEFHKV

SEQ ID NO: 209 - protein, 87 aa, Artificial Sequence
  Description of Artificial Sequence: Synthetic polypeptide
CLSSEFTCSSGQCVSRPWLCDGEDDCADGSDESEECGASVPTCQPGQFQCHSYPKCVPPIWVCDGVLDCLDSSDEADCSQDPEFHKV

SEQ ID NO: 210 - protein, 84 aa, Artificial Sequence
  Description of Artificial Sequence: Synthetic polypeptide
CLPDQFQCKNGSCVPGNWVCDGVNDCGDGSDETGCPKPTCEPGHFQCHSYYKCVPPIWVCDGVLDCLDSSDEADCSQDPEFHKV

SEQ ID NO: 211 - protein, 84 aa, Artificial Sequence
  Description of Artificial Sequence: Synthetic polypeptide
CLSDEFRCGSGKCIPVAWVCDGDNDCGDNSDESLELCRTAGPTCPGGAFMCRNATHCLGPELVCDGVPDCPDGSDETAHCPYRT

SEQ ID NO: 212 - protein, 83 aa, Artificial Sequence
  Description of Artificial Sequence: Synthetic polypeptide
CHSIAEFECRSGHCIPLEWVCDGDNDCADDSDEAGCTGTAPTCPGGAFMCRNTTHCLGPELVCDGVPDCPDGSDETAHCPYRT

SEQ ID NO: 213 - protein, 89 aa, Artificial Sequence
  Description of Artificial Sequence: Synthetic polypeptide
CQPFAEFECGSGNCIPGRWVCDGENDCPDGSDEPEQCSAPASEPPGSLCPGGAFMCRNTTHCLGPELVCDGVPDCPDGSDETAHCPYRT

SEQ ID NO: 214 - protein, 97 aa, Artificial Sequence
  Description of Artificial Sequence: Synthetic polypeptide
CNAFTQFECRSGKCIPAAWVCDGDNDCPDGSDESQHCGDSHILPFSTPGPSTCQPGQFQCHSYPKCVPPIWVCDGVLDCLDSSDEADCSQDPEFHKV

SEQ ID NO: 215 - protein, 86 aa, Artificial Sequence
  Description of Artificial Sequence: Synthetic polypeptide
CVSGQFQCGNGNCVSVPWGCDGVNDCGDSSDEESCRGTVPTCQPGQFQCHSYPKCVPPIWVCDGVLDCLDSSDEADCSQDPEFHKV

SEQ ID NO: 216 - protein, 86 aa, Artificial Sequence
  Description of Artificial Sequence: Synthetic polypeptide
CPANEFTCSNGSCVPEALLCDGEDDCRDNSDEANCGSPGPTCQPGQFQCHSYPKCVPPIWVCDGVLDCLDSSDEADCSQDPEFHKV

SEQ ID NO: 217 - protein, 84 aa, Artificial Sequence
  Description of Artificial Sequence: Synthetic polypeptide
CVADQFQCENGRCISAPWGCDGENDCADSSDETDCPAHTCEPGHFQCHSYPKCVPPIWVCDGVLDCLDSSDEADCSQDPEFHKV

SEQ ID NO: 218 - protein, 83 aa, Artificial Sequence
  Description of Artificial Sequence: Synthetic polypeptide
CLPSEFQCNNGHCISVNWLCDGDNDCGDGSDESAHCTGSTPTCPGGAFMCRNTTHCLGPELVCDGVPDCPDGSDETAHCPYRT

SEQ ID NO: 219 - protein, 82 aa, Artificial Sequence
  Description of Artificial Sequence: Synthetic polypeptide
CQPNQFPCNSGRCIPAGWICDGENDCGDNSDEASCAATVPTCPGGAFMCRNTTHCLGPELVCDGVPDCPDGSDETAHCPYRT

SEQ ID NO: 220 - protein, 97 aa, Artificial Sequence
  Description of Artificial Sequence: Synthetic polypeptide
CEPGQFQCHSYNKCVPPAWICDGVLDCLDSSDEANCSQDPEFHKVCPSGEFQCRGTKICIPPDWVCDGDNDCGDGSDESQHCGDSHILPFSTPGPST

SEQ ID NO: 221 - protein, 88 aa, Artificial Sequence
  Description of Artificial Sequence: Synthetic polypeptide
CQPGQFQCHSYPKCVPPIWVCDGVLDCLDSSDEADCSQDPEFHKVCLPGQFPCKSTGICIPADWVCDGDNDCGDGSDEPEQCATAEPT

SEQ ID NO: 222 - protein, 85 aa, Artificial Sequence
  Description of Artificial Sequence: Synthetic polypeptide
CAPGQFQCHGYETCIPLHWGCDGVNDCEDDSDEEGCPPPTCQPGQFQCHSYPKCVPPIWVCDGVLDCLDSSDEADCSQDPEFHKV

SEQ ID NO: 223 - protein, 94 aa, Artificial Sequence
  Description of Artificial Sequence: Synthetic polypeptide
CAPNQFRCNSYDKCVPAHWVCDGVLDCLDSSDETNCSAPASEPPGSLCAPNQFRCNSYDKCVPAHWVCDGVLDCLDSSDETNCSAPASEPPGSL

SEQ ID NO: 224 - protein, 90 aa, Artificial Sequence
  Description of Artificial Sequence: Synthetic polypeptide
SDVDECVILPGPCELDCVNTFDGYLCHCAPGFGGRLCVGGGGSCAPNQFRCNSYDKCVPAHWVCDGVLDCLDSSDETNCSAPASEPPGSL

SEQ ID NO: 225 - protein, 92 aa, Artificial Sequence
  Description of Artificial Sequence: Synthetic polypeptide
CEPGQFQCHSYNKCVPPAWICDGVLDCLDSSDEANCSQDPEFHKVCAPNQFRCNSYDKCVPAHWVCDGVLDCLDSSDETNCSAPASEPPGSL

SEQ ID NO: 226 - protein, 88 aa, Artificial Sequence
  Description of Artificial Sequence: Synthetic polypeptide
CPAYTEFLCKDSDRCFPSEWRCDGEMDCVDGSDELHCAYHTCAPNQFRCNSYDKCVPAHWVCDGVLDCLDSSDETNCSAPASEPPGSL

SEQ ID NO: 227 - protein, 88 aa, Artificial Sequence
  Description of Artificial Sequence: Synthetic polypeptide
CPGGAFMCRNTTHCLGPELVCDGVPDCPDGSDETAHCPYRTCAPNQFRCNSYDKCVPAHWVCDGVLDCLDSSDETNCSAPASEPPGSL

SEQ ID NO: 228 - protein, 92 aa, Artificial Sequence
  Description of Artificial Sequence: Synthetic polypeptide
CGSNEFPCQGSDICLAPEWLCDGDDDCLDFSDEAYCSQDPEFHKVCAPNQFRCNSYDKCVPAHWVCDGVLDCLDSSDETNCSAPASEPPGSL

SEQ ID NO: 229 - protein, 90 aa, Artificial Sequence
  Description of Artificial Sequence: Synthetic polypeptide
CAPNQFRCNSYDKCVPAHWVCDGVLDCLDSSDETNCSAPASEPPGSLSDVDECVILPGPCELDCVNTFDGYLCHCAPGFGGRLCVGGGGS

SEQ ID NO: 230 - protein, 86 aa, Artificial Sequence
  Description of Artificial Sequence: Synthetic polypeptide
SDVDECVILPGPCELDCVNTFDGYLCHCAPGFGGRLCVGGGGSSDVDECVILPGPCELDCVNTFDGYLCHCAPGFGGRLCVGGGGS

SEQ ID NO: 231 - protein, 88 aa, Artificial Sequence
  Description of Artificial Sequence: Synthetic polypeptide
CEPGQFQCHSYNKCVPPAWICDGVLDCLDSSDEANCSQDPEFHKVSDVDECVILPGPCELDCVNTFDGYLCHCAPGFGGRLCVGGGGS

SEQ ID NO: 232 - protein, 84 aa, Artificial Sequence
  Description of Artificial Sequence: Synthetic polypeptide
CPAYTEFLCKDSDRCFPSEWRCDGEMDCVDGSDELHCAYHTSDVDECVILPGPCELDCVNTFDGYLCHCAPGFGGRLCVGGGGS

SEQ ID NO: 233 - protein, 84 aa, Artificial Sequence
  Description of Artificial Sequence: Synthetic polypeptide
CPGGAFMCRNTTHCLGPELVCDGVPDCPDGSDETAHCPYRTSDVDECVILPGPCELDCVNTFDGYLCHCAPGFGGRLCVGGGGS

SEQ ID NO: 234 - protein, 88 aa, Artificial Sequence
  Description of Artificial Sequence: Synthetic polypeptide
CGSNEFPCQGSDICLAPEWLCDGDDDCLDFSDEAYCSQDPEFHKVSDVDECVILPGPCELDCVNTFDGYLCHCAPGFGGRLCVGGGGS

SEQ ID NO: 235 - protein, 92 aa, Artificial Sequence
  Description of Artificial Sequence: Synthetic polypeptide
CAPNQFRCNSYDKCVPAHWVCDGVLDCLDSSDETNCSAPASEPPGSLCEPGQFQCHSYNKCVPPAWICDGVLDCLDSSDEANCSQDPEFHKV

SEQ ID NO: 236 - protein, 88 aa, Artificial Sequence
  Description of Artificial Sequence: Synthetic polypeptide
SDVDECVILPGPCELDCVNTFDGYLCHCAPGFGGRLCVGGGGSCEPGQFQCHSYNKCVPPAWICDGVLDCLDSSDEANCSQDPEFHKV

SEQ ID NO: 237 - protein, 90 aa, Artificial Sequence
  Description of Artificial Sequence: Synthetic polypeptide
CEPGQFQCHSYNKCVPPAWICDGVLDCLDSSDEANCSQDPEFHKVCEPGQFQCHSYNKCVPPAWICDGVLDCLDSSDEANCSQDPEFHKV

SEQ ID NO: 238 - protein, 86 aa, Artificial Sequence
  Description of Artificial Sequence: Synthetic polypeptide
CPAYTEFLCKDSDRCFPSEWRCDGEMDCVDGSDELHCAYHTCEPGQFQCHSYNKCVPPAWICDGVLDCLDSSDEANCSQDPEFHKV

SEQ ID NO: 239 - protein, 86 aa, Artificial Sequence
  Description of Artificial Sequence: Synthetic polypeptide
CPGGAFMCRNTTHCLGPELVCDGVPDCPDGSDETAHCPYRTCEPGQFQCHSYNKCVPPAWICDGVLDCLDSSDEANCSQDPEFHKV

SEQ ID NO: 240 - protein, 90 aa, Artificial Sequence
  Description of Artificial Sequence: Synthetic polypeptide
CGSNEFPCQGSDICLAPEWLCDGDDDCLDFSDEAYCSQDPEFHKVCEPGQFQCHSYNKCVPPAWICDGVLDCLDSSDEANCSQDPEFHKV

SEQ ID NO: 241 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCKDSDRCFPSEWRCDGEMDCVDGSDELHCAYHT

SEQ ID NO: 242 - protein, 84 aa, Artificial Sequence
  Description of Artificial Sequence: Synthetic polypeptide
SDVDECVILPGPCELDCVNTFDGYLCHCAPGFGGRLCVGGGGSCPAYTEFLCKDSDRCFPSEWRCDGEMDCVDGSDELHCAYHT

SEQ ID NO: 243 - protein, 86 aa, Artificial Sequence
  Description of Artificial Sequence: Synthetic polypeptide
CEPGQFQCHSYNKCVPPAWICDGVLDCLDSSDEANCSQDPEFHKVCPAYTEFLCKDSDRCFPSEWRCDGEMDCVDGSDELHCAYHT

SEQ ID NO: 244 - protein, 82 aa, Artificial Sequence
  Description of Artificial Sequence: Synthetic polypeptide
CPAYTEFLCKDSDRCFPSEWRCDGEMDCVDGSDELHCAYHTCPAYTEFLCKDSDRCFPSEWRCDGEMDCVDGSDELHCAYHT

SEQ ID NO: 245 - protein, 82 aa, Artificial Sequence
  Description of Artificial Sequence: Synthetic polypeptide
CPGGAFMCRNTTHCLGPELVCDGVPDCPDGSDETAHCPYRTCPAYTEFLCKDSDRCFPSEWRCDGEMDCVDGSDELHCAYHT

SEQ ID NO: 246 - protein, 86 aa, Artificial Sequence
  Description of Artificial Sequence: Synthetic polypeptide
CGSNEFPCQGSDICLAPEWLCDGDDDCLDFSDEAYCSQDPEFHKVCPAYTEFLCKDSDRCFPSEWRCDGEMDCVDGSDELHCAYHT

SEQ ID NO: 247 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPGGAFMCRNTTHCLGPELVCDGVPDCPDGSDETAHCPYRT

SEQ ID NO: 248 - protein, 84 aa, Artificial Sequence
  Description of Artificial Sequence: Synthetic polypeptide
SDVDECVILPGPCELDCVNTFDGYLCHCAPGFGGRLCVGGGGSCPGGAFMCRNTTHCLGPELVCDGVPDCPDGSDETAHCPYRT

SEQ ID NO: 249 - protein, 86 aa, Artificial Sequence
  Description of Artificial Sequence: Synthetic polypeptide
CEPGQFQCHSYNKCVPPAWICDGVLDCLDSSDEANCSQDPEFHKVCPGGAFMCRNTTHCLGPELVCDGVPDCPDGSDETAHCPYRT

SEQ ID NO: 250 - protein, 82 aa, Artificial Sequence
  Description of Artificial Sequence: Synthetic polypeptide
CPAYTEFLCKDSDRCFPSEWRCDGEMDCVDGSDELHCAYHTCPGGAFMCRNTTHCLGPELVCDGVPDCPDGSDETAHCPYRT

SEQ ID NO: 251 - protein, 82 aa, Artificial Sequence
  Description of Artificial Sequence: Synthetic polypeptide
CPGGAFMCRNTTHCLGPELVCDGVPDCPDGSDETAHCPYRTCPGGAFMCRNTTHCLGPELVCDGVPDCPDGSDETAHCPYRT

SEQ ID NO: 252 - protein, 86 aa, Artificial Sequence
  Description of Artificial Sequence: Synthetic polypeptide
CGSNEFPCQGSDICLAPEWLCDGDDDCLDFSDEAYCSQDPEFHKVCPGGAFMCRNTTHCLGPELVCDGVPDCPDGSDETAHCPYRT

SEQ ID NO: 253 - protein, 92 aa, Artificial Sequence
  Description of Artificial Sequence: Synthetic polypeptide
CAPNQFRCNSYDKCVPAHWVCDGVLDCLDSSDETNCSAPASEPPGSLCGSNEFPCQGSDICLAPEWLCDGDDDCLDFSDEAYCSQDPEFHKV

SEQ ID NO: 254 - protein, 88 aa, Artificial Sequence
  Description of Artificial Sequence: Synthetic polypeptide
SDVDECVILPGPCELDCVNTFDGYLCHCAPGFGGRLCVGGGGSCGSNEFPCQGSDICLAPEWLCDGDDDCLDFSDEAYCSQDPEFHKV

SEQ ID NO: 255 - protein, 90 aa, Artificial Sequence
  Description of Artificial Sequence: Synthetic polypeptide
CEPGQFQCHSYNKCVPPAWICDGVLDCLDSSDEANCSQDPEFHKVCGSNEFPCQGSDICLAPEWLCDGDDDCLDFSDEAYCSQDPEFHKV

SEQ ID NO: 256 - protein, 86 aa, Artificial Sequence
  Description of Artificial Sequence: Synthetic polypeptide
CPAYTEFLCKDSDRCFPSEWRCDGEMDCVDGSDELHCAYHTCGSNEFPCQGSDICLAPEWLCDGDDDCLDFSDEAYCSQDPEFHKV

SEQ ID NO: 257 - protein, 86 aa, Artificial Sequence
  Description of Artificial Sequence: Synthetic polypeptide
CPGGAFMCRNTTHCLGPELVCDGVPDCPDGSDETAHCPYRTCGSNEFPCQGSDICLAPEWLCDGDDDCLDFSDEAYCSQDPEFHKV

SEQ ID NO: 258 - protein, 90 aa, Artificial Sequence
  Description of Artificial Sequence: Synthetic polypeptide
CGSNEFPCQGSDICLAPEWLCDGDDDCLDFSDEAYCSQDPEFHKVCGSNEFPCQGSDICLAPEWLCDGDDDCLDFSDEAYCSQDPEFHKV

SEQ ID NO: 259 - protein, 94 aa, Artificial Sequence
  Description of Artificial Sequence: Synthetic polypeptide
CGRDHFRCRSYDKCVPAHWLCDGVLDCLDSSDETYCSAPASEPPGSLCGRDHFRCRSYDKCVPAHWLCDGVLDCLDSSDETYCSAPASEPPGSL

SEQ ID NO: 260 - protein, 95 aa, Artificial Sequence
  Description of Artificial Sequence: Synthetic polypeptide
WCPPNHFMCNSYDKCVPAHWFCDGVLDCLDSSDETNCSAPASEPPGSLCPPNHFMCNSYDKCVPAHWFCDGVLDCLDSSDETNCSAPASEPPGSL

SEQ ID NO: 261 - protein, 95 aa, Artificial Sequence
  Description of Artificial Sequence: Synthetic polypeptide
WCPPNHFMCNSYDKCVPAHWFCDGVLDCLDSSDETNCSAPASEPPGSLCGRDHFRCRSYDKCVPAHWLCDGVLDCLDSSDETYCSAPASEPPGSL

SEQ ID NO: 262 - protein, 88 aa, Artificial Sequence
  Description of Artificial Sequence: Synthetic polypeptide
CPAYTEFLCKDSDRCFPSEWRCDGEMDCVDGSDELHCAYHTCGRDHFRCRSYDKCVPAHWLCDGVLDCLDSSDETYCSAPASEPPGSL

SEQ ID NO: 263 - protein, 88 aa, Artificial Sequence
  Description of Artificial Sequence: Synthetic polypeptide
CPAYTEFLCKDSDRCFPSEWRCDGEMDCVDGSDELHCAYHTCPPNHFMCNSYDKCVPAHWFCDGVLDCLDSSDETNCSAPASEPPGSL

SEQ ID NO: 264 - protein, 88 aa, Artificial Sequence
  Description of Artificial Sequence: Synthetic polypeptide
CPGGAFMCRNTTHCLGPELVCDGVPDCPDGSDETAHCPYRTCGRDHFRCRSYDKCVPAHWLCDGVLDCLDSSDETYCSAPASEPPGSL

SEQ ID NO: 265 - protein, 88 aa, Artificial Sequence
  Description of Artificial Sequence: Synthetic polypeptide
CPGGAFMCRNTTHCLGPELVCDGVPDCPDGSDETAHCPYRTCPPNHFMCNSYDKCVPAHWFCDGVLDCLDSSDETNCSAPASEPPGSL

SEQ ID NO: 266 - protein, 84 aa, Artificial Sequence
  Description of Artificial Sequence: Synthetic polypeptide
CPAYTEFLCKDSDRCFPSEWRCDGEMDCVDGSDELHCAYHTSDVDECVILPGPCELDCVNTFDDYVCHCKPSFGGVLCVGGGGS

SEQ ID NO: 267 - protein, 88 aa, Artificial Sequence
  Description of Artificial Sequence: Synthetic polypeptide
CGRDHFRCRSYDKCVPAHWLCDGVLDCLDSSDETYCSAPASEPPGSLCPAYTEFLCKDSDRCFPSEWRCDGEMDCVDGSDELHCAYHT

SEQ ID NO: 268 - protein, 89 aa, Artificial Sequence
  Description of Artificial Sequence: Synthetic polypeptide
WCPPNHFMCNSYDKCVPAHWFCDGVLDCLDSSDETNCSAPASEPPGSLCPAYTEFLCKDSDRCFPSEWRCDGEMDCVDGSDELHCAYHT

SEQ ID NO: 269 - protein, 92 aa, Artificial Sequence
  Description of Artificial Sequence: Synthetic polypeptide
CGRDHFRCRSYDKCVPAHWLCDGVLDCLDSSDETYCSAPASEPPGSLCGSREFPCQGTDICLPPEWICDGDDDCLDTSDEAYCSQDPEFHKV

SEQ ID NO: 270 - protein, 93 aa, Artificial Sequence
  Description of Artificial Sequence: Synthetic polypeptide
WCPPNHFMCNSYDKCVPAHWFCDGVLDCLDSSDETNCSAPASEPPGSLCGSREFPCQGTDICLPPEWICDGDDDCLDTSDEAYCSQDPEFHKV

SEQ ID NO: 271 - protein, 92 aa, Artificial Sequence
  Description of Artificial Sequence: Synthetic polypeptide
CGRDHFRCRSYDKCVPAHWLCDGVLDCLDSSDETYCSAPASEPPGSLCGSNEFPCQGSDICLAPEWLCDGDDDCLDFSDEAYCSQDPEFHKV

SEQ ID NO: 272 - protein, 93 aa, Artificial Sequence
  Description of Artificial Sequence: Synthetic polypeptide
WCPPNHFMCNSYDKCVPAHWFCDGVLDCLDSSDETNCSAPASEPPGSLCGSNEFPCQGSDICLAPEWLCDGDDDCLDFSDEAYCSQDPEFHKV

SEQ ID NO: 273 - protein, 85 aa, Artificial Sequence
  Description of Artificial Sequence: Synthetic polypeptide
CVILPGPCELDCVNTFDGYLCHCVPGFNGLNCQGGGGSCGRDHFRCRSYDKCVPAHWLCDGVLDCLDSSDETYCSAPASEPPGSL

SEQ ID NO: 274 - protein, 85 aa, Artificial Sequence
  Description of Artificial Sequence: Synthetic polypeptide
CVILPGPCELDCVNTFDGYLCHCVPGFNGLNCQGGGGSCPPNHFMCNSYDKCVPAHWFCDGVLDCLDSSDETNCSAPASEPPGSL

SEQ ID NO: 275 - protein, 90 aa, Artificial Sequence
  Description of Artificial Sequence: Synthetic polypeptide
SDVDECVILPGPCELDCVNTFDDYVCHCKPSFGGVLCVGGGGSCGRDHFRCRSYDKCVPAHWLCDGVLDCLDSSDETYCSAPASEPPGSL

SEQ ID NO: 276 - protein, 90 aa, Artificial Sequence
  Description of Artificial Sequence: Synthetic polypeptide
SDVDECVILPGPCELDCVNTFDDYVCHCKPSFGGVLCVGGGGSCPPNHFMCNSYDKCVPAHWFCDGVLDCLDSSDETNCSAPASEPPGSL

SEQ ID NO: 277 - protein, 93 aa, Artificial Sequence
  Description of Artificial Sequence: Synthetic polypeptide
CAPNQFRCNSYDKCVPAHWVCDGVLDCLDSSDETNCSAPASEPPGSLCGSNEFPCQGSDICLAPEWLCDGDDDCLDFSDEAYCGGGGSGGGGS

SEQ ID NO: 278 - protein, 92 aa, Artificial Sequence
  Description of Artificial Sequence: Synthetic polypeptide
CAPNQFRCNSYDKCVPAHWVCDGVLDCLDSSDETNCSAPASEPPGSLCGSNEFPCQGSDICLAPEWLCDGDDDCLDFSDEAYCSQDPEFSAV

SEQ ID NO: 279 - protein, 87 aa, Artificial Sequence
  Description of Artificial Sequence: Synthetic polypeptide
CAPSEFTCNNGHCIPPQWVCDGVDDCGDGSDEPPHCKATAPTCGSREFPCQGPDICLPPEWICDGDDDCLDTSDEAYCSQDPEFHKV

SEQ ID NO: 280 - protein, 89 aa, Artificial Sequence
  Description of Artificial Sequence: Synthetic polypeptide
CASGEFTCGNGYCIPLQWVCDGVDDCGDGSDETGCSQDPEFHKVCGSREFPCQGTDICLPPAWLCDGDDDCLDTPDEAYCSQDPEFHKV

SEQ ID NO: 281 - protein, 89 aa, Artificial Sequence
  Description of Artificial Sequence: Synthetic polypeptide
CASGEFTCGNGYCIPLQWVCDGVDDCGDGSDETGCSQDPEFHKVCGSREFPCQGTDICLPPEWICDGDDDCLDTPDEAYCSQDPEFHKV

SEQ ID NO: 282 - protein, 87 aa, Artificial Sequence
  Description of Artificial Sequence: Synthetic polypeptide
CPSGQFTCGNGYCIPEEWVCDGVDDCGDGSDEPPLCETAVPTCGSREFPCQGTDICLPPEWICDGDDDCLDTPDEAYCSQDPEFHKV

SEQ ID NO: 283 - protein, 87 aa, Artificial Sequence
  Description of Artificial Sequence: Synthetic polypeptide
CRANEFKCSNGHCVPREWVCDGVDDCGDGSDEPADCERAEPTCGSREFPCQGTDICLPPAWLCDGDDDCLDTPDEAYCSQDPEFHKV

SEQ ID NO: 284 - protein, 86 aa, Artificial Sequence
  Description of Artificial Sequence: Synthetic polypeptide
CPPGQFKCSNGHCIPETWVCDGVDDCGDGSDESPDCERTEPTCGSREFPCQGTDICLPPEWICDGDDDCLDTPDEAYCSQDPEFHK

SEQ ID NO: 285 - protein, 85 aa, Artificial Sequence
  Description of Artificial Sequence: Synthetic polypeptide
CPADQFRCGSGHCVPLAWVCDGVDDCADGSDEAEQCTPPTCGSYEFPCQGTDICLLPAWLCDGDADCRDYSDETDCSQDPEFHKV

SEQ ID NO: 286 - protein, 91 aa, Artificial Sequence
  Description of Artificial Sequence: Synthetic polypeptide
CPSGEFRCKNGRCIPAAWLCDGEPDCRDSSDEAGCSAPASEPPGSLCGSREFPCQGTDICLPPEWICDGDDDCLDTSDEAYCSQDPEFHKV

SEQ ID NO: 287 - protein, 45 aa, Artificial Sequence
  Description of Artificial Sequence: Synthetic polypeptide
CGSREFPCQGTDICLLPAWLCDGDADCRYYSDETDCSQDPEFHKV

SEQ ID NO: 288 - protein, 45 aa, Artificial Sequence
  Description of Artificial Sequence: Synthetic polypeptide
CGSREFPCQGTDICLPPEWICDGDDDCLETSDEAYCSQDPEFHKV

SEQ ID NO: 289 - protein, 45 aa, Artificial Sequence
  Description of Artificial Sequence: Synthetic polypeptide
CGSREFPCQGTDLCLPPEWICDGDDDCLDTPDEAYCSQDPEFHKV

SEQ ID NO: 290 - protein, 45 aa, Artificial Sequence
  Description of Artificial Sequence: Synthetic polypeptide
CGSYEFPCQGTDICLLPAWLCDGDADCRYYSDETDCSQDPEFHKV

SEQ ID NO: 291 - protein, 90 aa, Artificial Sequence
  Description of Artificial Sequence: Synthetic polypeptide
CASNQFTCGNGHCLPPQWVCDGVDDCGDGSDEPADCSQDPEFHKVCGSREFPCQGTDICLPPAWLCDGDDDCLDTSDEAYCSQDPEFHKV

SEQ ID NO: 292 - protein, 93 aa, Artificial Sequence
  Description of Artificial Sequence: Synthetic polypeptide
CASSQFTCGSGRCVPVEWLCDGENDCGDGSDEAGCGRPGPGATSAPAACEPGQFQCHSYPKCVPPIWVCDGVLDCLDSSDEADCSQDPEFHKV

SEQ ID NO: 293 - protein, 86 aa, Artificial Sequence
  Description of Artificial Sequence: Synthetic polypeptide
CEASQFKCHSSGRCIPVGWVCDGENDCADGSDEPAECPARTCGSREFPCQGTDICLPPAWLCDGDDDCLDNPDEAYCSQDPEFHKV

SEQ ID NO: 294 - protein, 90 aa, Artificial Sequence
  Description of Artificial Sequence: Synthetic polypeptide
CEPGQFQCHSYNKCVPPAWICDGVLDCLDSSDEANCSQDPEFHKVCEPDQFTCRSNGRCIPLGWVCDGDNDCVDDSDEKSCSQDPEFHKV

SEQ ID NO: 295 - protein, 93 aa, Artificial Sequence
  Description of Artificial Sequence: Synthetic polypeptide
CGAGEFTCNNGRCIPEPWLCDGVDDCRDSSDEPPAHCSAPASEPPGSLCGSREFPCQGTDICLPPEWICDGDDDCLDTSDEAYCSQDPEFHKV

SEQ ID NO: 296 - protein, 93 aa, Artificial Sequence
  Description of Artificial Sequence: Synthetic polypeptide
CHPFGEFECESGKCVPLGLVCDGVNDCRDNSDEPALCSAPASEPPGSLCGSREFPCQGTDICLPPEWICDGDDDCLDTPDEAYCSQDPEFHKV

SEQ ID NO: 297 - protein, 91 aa, Artificial Sequence
  Description of Artificial Sequence: Synthetic polypeptide
CHPFGQFECGSGSCIPGAWVCDGVNDCGDGSDEPQHCGRPGPGATSAPAACPGGAFMCRNTTHCLGPELVCDGVPDCPDGSDETAHCPYRT

SEQ ID NO: 298 - protein, 91 aa, Artificial Sequence
  Description of Artificial Sequence: Synthetic polypeptide
CHPFGQFECRSGQCIPLPWLCDGEDDCADGSDEPQDCGRPGPGATSAPAACPGGAFMCRNTTHCLGPELVCDGVPDCPDGSDETAHCPYRT

SEQ ID NO: 299 - protein, 89 aa, Artificial Sequence
  Description of Artificial Sequence: Synthetic polypeptide
CHPYAEFGCSSGKCIPAPLVCDGVNDCGDGSDEPQHCSAPASEPPGSLCPAFTEFLCKDSNRCYPSEWRCDGEVDCTDGSDELHCAYHT

SEQ ID NO: 300 - protein, 90 aa, Artificial Sequence
  Description of Artificial Sequence: Synthetic polypeptide
CLPGQFPCKNGRCISEQWVCDGDNDCPDGSDESALCSQDPEFHKVCGSREFPCQGTDICLPPEWICDGDDDCLDTPDEAYCSQDPEFHKV

SEQ ID NO: 301 - protein, 90 aa, Artificial Sequence
  Description of Artificial Sequence: Synthetic polypeptide
CLSDQFQCGNGQCIPVRWVCDGVNDCGDGSDEPALCSQDPEFHKVCGSREFPCQGTDICLPPEWICDGDDDCLDTSDEAYCSQDPEFHKV

SEQ ID NO: 302 - protein, 87 aa, Artificial Sequence
  Description of Artificial Sequence: Synthetic polypeptide
CLSSQFKCSNGNCIPEQWVCDGVNDCGDGSDEPEHCTGPVHTCGSREFPCQGPDICLPPAWLCDGDDDCLDNPDEAYCSQDPEFHKV

SEQ ID NO: 303 - protein, 80 aa, Artificial Sequence
  Description of Artificial Sequence: Synthetic polypeptide
CPAFTEFLCKDSDRCFPSEWRCDGEMDCVDGSDELHCAYHTCRSGQFRCGNGHCIPPSWLCDGDNDCPDDSDEKGCSPDP

SEQ ID NO: 304 - protein, 92 aa, Artificial Sequence
  Description of Artificial Sequence: Synthetic polypeptide
CPAFTEFLCKDSNRCYPSEWRCDGEVDCTDGSDELHCAYHTCAPSEFRCSNGKCVPAQWVCDGVNDCADGSDEPQHCGDSHILPFSTPGPST

SEQ ID NO: 305 - protein, 90 aa, Artificial Sequence
  Description of Artificial Sequence: Synthetic polypeptide
CPAFTEFLCKDSNRCYPSEWRCDGEVDCTDGSDELHCAYHTCPSSQFTCRNSGKCIPRPLLCDGDNDCGDDSDEPLAHCSAPASEPPGSL

SEQ ID NO: 306 - protein, 87 aa, Artificial Sequence
  Description of Artificial Sequence: Synthetic polypeptide
CPAGQFTCGNGHCIPLPWLCDGANDCGDGSDEAPQCETAAPTCGSREFPCQGPDICLPPEWICDGDDDCLETSDEAYCSQDPEFHKV

SEQ ID NO: 307 - protein, 90 aa, Artificial Sequence
  Description of Artificial Sequence: Synthetic polypeptide
CPAGQFTCSNGHCIPVQWVCDGVDDCGDGSDESAVCSQDPEFHKVCGSREFPCQGTDICLPPEWICDGDDDCLDTPDEAYCSQDPEFHKV

SEQ ID NO: 308 - protein, 89 aa, Artificial Sequence
  Description of Artificial Sequence: Synthetic polypeptide
CPASQFKCENGNCIPGHWVCDGVDDCGDNSDEASCSQDPEFHKVCGSREFPCQGTDICLPPAWLCDGDDDCLDNPDEAYCSQDPEFHKV

SEQ ID NO: 309 - protein, 89 aa, Artificial Sequence
  Description of Artificial Sequence: Synthetic polypeptide
CPAYTEFLCKDSDRCFPSEWRCDGEMDCVDGSDELHCAYHACPSNQFTCSNGNCLSLAWLCDGVPDCGDDSDEANCGRPGPGATSAPAA

SEQ ID NO: 310 - protein, 83 aa, Artificial Sequence
  Description of Artificial Sequence: Synthetic polypeptide
CPAYTEFLCKDSDRCFPSEWRCDGEMDCVDGSDELHCAYHTCAPNQFRCNSYDKCVPAHWVCDGVLDCLDNSDEADCTATVPT

SEQ ID NO: 311 - protein, 88 aa, Artificial Sequence
  Description of Artificial Sequence: Synthetic polypeptide
CPAYTEFLCKDSDRCFPSEWRCDGEMDCVDGSDELHCAYHTCPSSQFQCHNSETCIPQTWVCDGADDCQDDSDEKSCSAPASEPPGSL

SEQ ID NO: 312 - protein, 89 aa, Artificial Sequence
  Description of Artificial Sequence: Synthetic polypeptide
CPAYTEFLCKDSDRCFPSEWRCDGEMDCVDGSDELHCAYHTCVADQFRCDNGKCISENLGCDGDNDCPDGSDEAGCGRPGPGATSAPAA

SEQ ID NO: 313 - protein, 83 aa, Artificial Sequence
  Description of Artificial Sequence: Synthetic polypeptide
CPAYTEFLCKDSDRCFPSEWRCDGEMDCVDGSDELHCAYHTCVPNEFPCSNGHCLSEPWGCDGDDDCRDGSDEPPDCETSGRT

SEQ ID NO: 314 - protein, 88 aa, Artificial Sequence
  Description of Artificial Sequence: Synthetic polypeptide
CPAYTEFLCKDSNRCYPSEWRCDGEVDCTDGSDELHCAYHTCGSGQFRCNSYDKCVPAHWVCDGVLDCLDSSDETNCSAPASEPPGSL

SEQ ID NO: 315 - protein, 92 aa, Artificial Sequence
  Description of Artificial Sequence: Synthetic polypeptide
CPPNQFQCGSGRCIPEHWVCDGENDCGDGSDEPAVCSAPASEPPGSLCGSREFPCQGTDICLPPAWLCDGDDDCLDNPDEAYCSQDPEFHKV

SEQ ID NO: 316 - protein, 92 aa, Artificial Sequence
  Description of Artificial Sequence: Synthetic polypeptide
CPPSQFPCDSGKCIPVHWVCDGENDCRDGSDEPALCSAPASEPPGSLCGSREFPCQGTDICLPPAWLCDGDDDCLDNPDEAYCSQDPEFHKV

SEQ ID NO: 317 - protein, 87 aa, Artificial Sequence
  Description of Artificial Sequence: Synthetic polypeptide
CPSDQFQCGNGHCIPAPWVCDGVDDCGDGSDEPQHCTTSEPTCGSREFPCQGTDICLPPAWLCDGDDDCLDNPDEAYCSQDPEFHKV

SEQ ID NO: 318 - protein, 87 aa, Artificial Sequence
  Description of Artificial Sequence: Synthetic polypeptide
CQPSQFPCGNGHCIPEQWLCDGVNDCGDGSDEPELCTRSEPTCGSREFPCQGTDICLPPEWICDGDDDCLDTSDEAYCSQDPEFHKV

SEQ ID NO: 319 - protein, 87 aa, Artificial Sequence
  Description of Artificial Sequence: Synthetic polypeptide
CQSGQFQCNSGQCIPREWVCDGVPDCGDGSDEPEDCTTSAHTCGSREFPCQGTDICLPPEWICDGDDDCLDTPDEAYCSQDPEFHKV

SEQ ID NO: 320 - protein, 87 aa, Artificial Sequence
  Description of Artificial Sequence: Synthetic polypeptide
CRAGEFQCNSGHCIPLPWLCDGVPDCGDGSDEPAVCAGSVPTCGSREFPCQGTDICLPPAWLCDGDDDCLDNPDEAYCSQDPEFHKG

SEQ ID NO: 321 - protein, 93 aa, Artificial Sequence
  Description of Artificial Sequence: Synthetic polypeptide
CRPSEFPCKSGHCISPQWGCDGDPDCGDNSDEPPDPCSAPASEPPGSLCGSSEFPCQGTDICLPPEWICDGDDDCLETSDEAYCSQDPEFHKV

SEQ ID NO: 322 - protein, 91 aa, Artificial Sequence
  Description of Artificial Sequence: Synthetic polypeptide
CRSDEFRCRNGHCIPGRWVCDGVDDCGDGSDETDCSAPASEPPGSLCGSREFPCQGTDICLPPEWICDGDDDCLETSDEAYCSQDPEFHKV

SEQ ID NO: 323 - protein, 91 aa, Artificial Sequence
  Description of Artificial Sequence: Synthetic polypeptide
CRSDEFTCKNGHCIPGRWVCDGVDDCGDGSDEEGCSAPASEPSGSLCGSREFPCQGTDICLPPAWLCDGDDDCLDNPDEAYCSQDPEFHKV

SEQ ID NO: 324 - protein, 90 aa, Artificial Sequence
  Description of Artificial Sequence: Synthetic polypeptide
CRSDQFTCGNGHCIPARWVCDGVDDCGDGSDEPEHCSQDPEFHKVCGSREFPCQGTDICLPPAWLCDGDDDCLDNPDEAYCSQDPEFHKV

SEQ ID NO: 325 - protein, 92 aa, Artificial Sequence
  Description of Artificial Sequence: Synthetic polypeptide
CVSGQFTCDSGKCVSAAWLCDGENDCGDGSDEPQVCSAPASEPPGSLCQPGQFQCHSYPKCVPPIWVCDGVLDCLDSSDEADCSQDPEFHKV

SEQ ID NO: 326 - protein, 91 aa, Artificial Sequence
  Description of Artificial Sequence: Synthetic polypeptide
CVSGQFTCGNGKCVSQTWLCDGEDDCGDDSDEKDCSAPASEPPGSLCQPGQFQCHSYPKCVPPIWVCDGVLDCLDSSDEADCSQDPEFHKV

SEQ ID NO: 327 - protein, 85 aa, Artificial Sequence
  Description of Artificial Sequence: Synthetic polypeptide
SDVDECFANPCPTGVCVNTSDGFTCDCEPGFDGNSCEVEQVSSDVDECVILPGPCELDCVNTFDGYLCHCAPSFGGRLCVGGGGS

SEQ ID NO: 328 - protein, 41 aa, Artificial Sequence
  Description of Artificial Sequence: Synthetic polypeptide
CPDFTEFLCKDSNRCYPSEWRCDGEMDCADGSDELHCAYHT

SEQ ID NO: 329 - protein, 325 aa, Artificial Sequence
  Description of Artificial Sequence: Synthetic polypeptide
MAWTVLLLGLLSHCTGSVTSSGGSCPAGQFTCGNGHCIPLPWLCDGANDCGDGSDEAPQCETAAPTCGSREFPCQGPDICLPPEWICDGDDDCLETSDEAYCSQDPEFHKVSYVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 330 - protein, 326 aa, Artificial Sequence
  Description of Artificial Sequence: Synthetic polypeptide
MAWTVLLLGLLSHCTGSVTSSGGSCPAYTEFLCKDSNRCYPSEWRCDGEVDCTDGSDELHCAYHTCGSGQFRCNSYDKCVPAHWVCDGVLDCLDSSDETNCSAPASEPPGSLSYVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 331 - protein, 328 aa, Artificial Sequence
  Description of Artificial Sequence: Synthetic polypeptide
MAWTVLLLGLLSHCTGSVTSYVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAGQFTCGNGHCIPLPWLCDGANDCGDGSDEAPQCETAAPTCGSREFPCQGPDICLPPEWICDGDDDCLETSDEAYCSQDPEFHKVSLQ

SEQ ID NO: 332 - protein, 329 aa, Artificial Sequence
  Description of Artificial Sequence: Synthetic polypeptide
MAWTVLLLGLLSHCTGSVTSYVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCKDSNRCYPSEWRCDGEVDCTDGSDELHCAYHTCGSGQFRCNSYDKCVPAHWVCDGVLDCLDSSDETNCSAPASEPPGSLSLQ

SEQ ID NO: 333 - protein, 553 aa, Artificial Sequence
  Description of Artificial Sequence: Synthetic polypeptide
MEFGLSWVFLVALLRGVQCSGGSCPAGQFTCGNGHCIPLPWLCDGANDCGDGSDEAPQCETAAPTCGSREFPCQGPDICLPPEWICDGDDDCLETSDEAYCSQDPEFHKVSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 334 - protein, 554 aa, Artificial Sequence
  Description of Artificial Sequence: Synthetic polypeptide
MEFGLSWVFLVALLRGVQCSGGSCPAYTEFLCKDSNRCYPSEWRCDGEVDCTDGSDELHCAYHTCGSGQFRCNSYDKCVPAHWVCDGVLDCLDSSDETNCSAPASEPPGSLSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 335 - protein, 556 aa, Artificial Sequence
  Description of Artificial Sequence: Synthetic polypeptide
MEFGLSWVFLVALLRGVQCQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCPAGQFTCGNGHCIPLPWLCDGANDCGDGSDEAPQCETAAPTCGSREFPCQGPDICLPPEWICDGDDDCLETSDEAYCSQDPEFHKVSLQ

SEQ ID NO: 336 - protein, 557 aa, Artificial Sequence
  Description of Artificial Sequence: Synthetic polypeptide
MEFGLSWVFLVALLRGVQCQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCPAYTEFLCKDSNRCYPSEWRCDGEVDCTDGSDELHCAYHTCGSGQFRCNSYDKCVPAHWVCDGVLDCLDSSDETNCSAPASEPPGSLSLQ

SEQ ID NO: 337 - protein, 535 aa, Artificial Sequence
  Description of Artificial Sequence: Synthetic polypeptide
SGGSCPAYTEFLCKDSDRCFPSEWRCDGEMDCVDGSDELHCAYHTCAPNQFRCNSYDKCVPAHWVCDGVLDCLDSSDETNCSAPASEPPGSLSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 338 - protein, 538 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCPAYTEFLCKDSDRCFPSEWRCDGEMDCVDGSDELHCAYHTCAPNQFRCNSYDKCVPAHWVCDGVLDCLDSSDETNCSAPASEPPGSLSLQ

SEQ ID NO: 339 - protein, 539 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSWCPPNHFMCNSYDKCVPAHWFCDGVLDCLDSSDETNCSAPASEPPGSLCPAYTEFLCKDSDRCFPSEWRCDGEMDCVDGSDELHCAYHTSLQ

SEQ ID NO: 340 - protein, 538 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCGRDHFRCRSYDKCVPAHWLCDGVLDCLDSSDETYCSAPASEPPGSLCPAYTEFLCKDSDRCFPSEWRCDGEMDCVDGSDELHCAYHTSLQ

SEQ ID NO: 341 - protein, 536 aa, Artificial Sequence
  Description of Artificial Sequence: Synthetic polypeptide
SGGSWCPPNHFMCNSYDKCVPAHWFCDGVLDCLDSSDETNCSAPASEPPGSLCPAYTEFLCKDSDRCFPSEWRCDGEMDCVDGSDELHCAYHTSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 342 - protein, 538 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCAPNQFRCNSYDKCVPAHWVCDGVLDCLDSSDETNCSAPASEPPGSLCPAYTEFLCKDSDRCFPSEWRCDGEMDCVDGSDELHCAYHTSLQ

SEQ ID NO: 343 - protein, 309 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCKDSDRCFPSEWRCDGEMDCVDGSDELHCAYHTCAPNQFRCNSYDKCVPAHWVCDGVLDCLDSSDETNCSAPASEPPGSLSLQ

SEQ ID NO: 344 - protein, 88 aa, Artificial Sequence
  Description of Artificial Sequence: Synthetic polypeptide
CPAYTEFLCADSDRCFPSEWRCDGEMDCVDGSDELHCAYHTCAPNQFRCNSYDKCVPAHWVCDGVLDCLDSSDETNCSAPASEPPGSL

SEQ ID NO: 345 - protein, 88 aa, Artificial Sequence
  Description of Artificial Sequence: Synthetic polypeptide
CPAYTEFLCKDSDACFPSEWRCDGEMDCVDGSDELHCAYHTCAPNQFRCNSYDKCVPAHWVCDGVLDCLDSSDETNCSAPASEPPGSL

SEQ ID NO: 346 - protein, 88 aa, Artificial Sequence
  Description of Artificial Sequence: Synthetic polypeptide
CPAYTEFLCKDSDRCFPSEWACDGEMDCVDGSDELHCAYHTCAPNQFRCNSYDKCVPAHWVCDGVLDCLDSSDETNCSAPASEPPGSL

SEQ ID NO: 347 - protein, 88 aa, Artificial Sequence
  Description of Artificial Sequence: Synthetic polypeptide
CPAYTEFLCKDSDRCFPSEWRCDGEMECVDGSDELHCAYHTCAPNQFRCNSYDKCVPAHWVCDGVLDCLDSSDETNCSAPASEPPGSL

SEQ ID NO: 348 - protein, 88 aa, Artificial Sequence
  Description of Artificial Sequence: Synthetic polypeptide
CPAYTEFLCKDSDRCFPSEWRCDGEMDCVDGSDELHCAYHACAPNQFRCNSYDKCVPAHWVCDGVLDCLDSSDETNCSAPASEPPGSL

SEQ ID NO: 349 - protein, 88 aa, Artificial Sequence
  Description of Artificial Sequence: Synthetic polypeptide
CPAYTEFLCKDSDRCFPSEWRCDGEMDCVDGSDELHCAYHTCAPNQFACNSYDKCVPAHWVCDGVLDCLDSSDETNCSAPASEPPGSL

SEQ ID NO: 350 - protein, 88 aa, Artificial Sequence
  Description of Artificial Sequence: Synthetic polypeptide
CPAYTEFLCKDSDRCFPSEWRCDGEMDCVDGSDELHCAYHTCAPNQFLCNSYDKCVPAHWVCDGVLDCLDSSDETNCSAPASEPPGSL

SEQ ID NO: 351 - protein, 88 aa, Artificial Sequence
  Description of Artificial Sequence: Synthetic polypeptide
CPAYTEFLCKDSDRCFPSEWRCDGEMDCVDGSDELHCAYHTCAPNQFRCNSYDACVPAHWVCDGVLDCLDSSDETNCSAPASEPPGSL

SEQ ID NO: 352 - protein, 88 aa, Artificial Sequence
  Description of Artificial Sequence: Synthetic polypeptide
CPAYTEFLCKDSDRCFPSEWRCDGEMDCVDGSDELHCAYHTCAPNQFRCNSYDKCVPAHWVCDGVLDCLDSSDETNCSAPAAEPPGSL

SEQ ID NO: 353 - protein, 88 aa, Artificial Sequence
  Description of Artificial Sequence: Synthetic polypeptide
CPAYTEFLCKDSDRCFPSEWRCDGEMDCVDGSDELHCGGGGCAPNQFRCNSYDKCVPAHWVCDGVLDCLDSSDETNCSAPASEPPGSL

SEQ ID NO: 354 - protein, 87 aa, Artificial Sequence
  Description of Artificial Sequence: Synthetic polypeptide
CPAYTEFLCKDSDRCFPSEWRCDGEMDCVDGSDELHCAYHTCAPNQFRCNSYDKCVPAHWVCDGVLDCLDSSDETNCGGGGSGGGGS

SEQ ID NO: 355 - protein, 88 aa, Artificial Sequence
  Description of Artificial Sequence: Synthetic polypeptide
CAPNQFRCNSYDACVPAHWVCDGVLDCLDSSDETNCSAPASEPPGSLCPAYTEFLCKDSDRCFPSEWRCDGEMDCVDGSDELHCAYHT

SEQ ID NO: 356 - protein, 88 aa, Artificial Sequence
  Description of Artificial Sequence: Synthetic polypeptide
CAPNQFRCNSYDKCVPAHWVCDGVLDCLDSSDETNCSAPAAEPPGSLCPAYTEFLCKDSDRCFPSEWRCDGEMDCVDGSDELHCAYHT

SEQ ID NO: 357 - protein, 87 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCKDSDRCFPSEWRCDGEMDCVDGSDELHCAYHT

SEQ ID NO: 358 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCADSDRCFPSEWRCDGEMDCVDGSDELHCAYHT

SEQ ID NO: 359 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCKDSDACFPSEWRCDGEMDCVDGSDELHCAYHT

SEQ ID NO: 360 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCKDSDRCFPSEWACDGEMDCVDGSDELHCAYHT

SEQ ID NO: 361 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCKDSDRCFPSEWRCDGEMDCVDGSDELHCAYHA

SEQ ID NO: 362 - protein, 88 aa, Artificial Sequence
  Description of Artificial Sequence: Synthetic polypeptide
CAPNQFRCNSYDKCVPAHWVCDGVLDCLDSSDETNCSAPASEPPGSLCPAYTEFLCKDSDRCFPSEWRCDGEMDCVDGSDELHCGGGG

SEQ ID NO: 363 - protein, 87 aa, Artificial Sequence
  Description of Artificial Sequence: Synthetic polypeptide
CPAGQFTCGNGHCIPLPWLCDGANDCGDGSDEAPQCETAAPTCGSAEFPCQGPDICLPPEWICDGDDDCLETSDEAYCSQDPEFHKV

SEQ ID NO: 364 - protein, 87 aa, Artificial Sequence
  Description of Artificial Sequence: Synthetic polypeptide
CPAGQFTCGNGHCIPLPWLCDGANDCGDGSDEAPQCETAAPTCGSYEFPCQGPDICLPPEWICDGDDDCLETSDEAYCSQDPEFHKV

SEQ ID NO: 365 - protein, 87 aa, Artificial Sequence
  Description of Artificial Sequence: Synthetic polypeptide
CPAGQFTCGNGHCIPLPWLCDGANDCGDGSDEAPQCETAAPTCGSREFPCQGPDICLPPEWICDGDDDCLETSDEAYCSQDPEFHAV

SEQ ID NO: 366 - protein, 88 aa, Artificial Sequence
  Description of Artificial Sequence: Synthetic polypeptide
CPAGQFTCGNGHCIPLPWLCDGANDCGDGSDEAPQCETAAPTCGSREFPCQGPDICLPPEWICDGDDDCLETSDEAYCGGGGSGGGGS

SEQ ID NO: 367 - protein, 87 aa, Artificial Sequence
  Description of Artificial Sequence: Synthetic polypeptide
CPSGQFTCGNGYCIPEEWVCDGVDDCGDGSDEPPLCETAVPTCGSAEFPCQGTDICLPPEWICDGDDDCLDTPDEAYCSQDPEFHKV

SEQ ID NO: 368 - protein, 87 aa, Artificial Sequence
  Description of Artificial Sequence: Synthetic polypeptide
CPSGQFTCGNGYCIPEEWVCDGVDDCGDGSDEPPLCETAVPTCGSYEFPCQGTDICLPPEWICDGDDDCLDTPDEAYCSQDPEFHKV

SEQ ID NO: 369 - protein, 87 aa, Artificial Sequence
  Description of Artificial Sequence: Synthetic polypeptide
CPSGQFTCGNGYCIPEEWVCDGVDDCGDGSDEPPLCETAVPTCGSREFPCQGTDICLPPEWICDGDDDCLDTPDEAYCSQDPEFHAV

SEQ ID NO: 370 - protein, 88 aa, Artificial Sequence
  Description of Artificial Sequence: Synthetic polypeptide
CPSGQFTCGNGYCIPEEWVCDGVDDCGDGSDEPPLCETAVPTCGSREFPCQGTDICLPPEWICDGDDDCLDTPDEAYCGGGGSGGGGS

SEQ ID NO: 371 - protein, 88 aa, Artificial Sequence
  Description of Artificial Sequence: Synthetic polypeptide
CPAGQFTCGNGHCIPLPWLCDGANDCGDGSDEAPQCETAAPTCGSAEFPCQGPDICLPPEWICDGDDDCLETSDEAYCGGGGSGGGGS

SEQ ID NO: 372 - protein, 88 aa, Artificial Sequence
  Description of Artificial Sequence: Synthetic polypeptide
CPSGQFTCGNGYCIPEEWVCDGVDDCGDGSDEPPLCETAVPTCGSAEFPCQGTDICLPPEWICDGDDDCLDTPDEAYCGGGGSGGGGS

SEQ ID NO: 373 - protein, 87 aa, Artificial Sequence
  Description of Artificial Sequence: Synthetic polypeptide
CPAYTEFLCADSDACFPSEWACDGEMDCVDGSDELHCGGGGCAPNQFACNSYDACVPAHWVCDGVLDCLDSSDETNCGGGGSGGGGS

SEQ ID NO: 374 - protein, 87 aa, Artificial Sequence
  Description of Artificial Sequence: Synthetic polypeptide
CPAYTEFLCADSDACFPSEWACDGEMDCVDGSDELHCGGGGCAPNQFACNSYDKCVPAHWVCDGVLDCLDSSDETNCGGGGSGGGGS

SEQ ID NO: 375 - protein, 87 aa, Artificial Sequence
  Description of Artificial Sequence: Synthetic polypeptide
CPAYTEFLCADSDACFPSEWRCDGEMDCVDGSDELHCGGGGCAPNQFACNSYDKCVPAHWVCDGVLDCLDSSDETNCGGGGSGGGGS

SEQ ID NO: 376 - protein, 87 aa, Artificial Sequence
  Description of Artificial Sequence: Synthetic polypeptide
CPAYTEFLCADSDACFPSEWRCDGEMDCVDGSDELHCGGGGCAPNQFACNSYDACVPAHWVCDGVLDCLDSSDETNCGGGGSGGGGS

SEQ ID NO: 377 - protein, 87 aa, Artificial Sequence
  Description of Artificial Sequence: Synthetic polypeptide
CPAYTEFLCADSDACFPSEWRCDGEMDCVDGSDELHCGGGGCAPNQFRCNSYDKCVPAHWVCDGVLDCLDSSDETNCGGGGSGGGGS

SEQ ID NO: 378 - protein, 87 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCADSDACFPSEWACDGEMDCVDGSDELHCGGGG

SEQ ID NO: 379 - protein, 87 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCKDSDACFPSEWACDGEMDCVDGSDELHCGGGG

SEQ ID NO: 380 - protein, 87 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCADSDRCFPSEWACDGEMDCVDGSDELHCGGGG

SEQ ID NO: 381 - protein, 87 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCADSDACFPSEWRCDGEMDCVDGSDELHCGGGG

SEQ ID NO: 382 - protein, 87 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCADSDACFPSEWACDGEMDCVDGSDELHCGGGG

SEQ ID NO: 383 - protein, 87 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCKDSDACFPSEWACDGEMDCVDGSDELHCGGGG

SEQ ID NO: 384 - protein, 87 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCADSDRCFPSEWACDGEMDCVDGSDELHCGGGG

SEQ ID NO: 385 - protein, 87 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCADSDACFPSEWRCDGEMDCVDGSDELHCGGGG

SEQ ID NO: 386 - protein, 88 aa, Artificial Sequence
  Description of Artificial Sequence: Synthetic polypeptide
WCPPNHFMCNSYDKCVPAHWFCDGVLDCLDSSDETNCGGGGSGGGGSCPAYTEFLCADSDACFPSEWACDGEMDCVDGSDELHCGGGG

SEQ ID NO: 387 - protein, 87 aa, Artificial Sequence
  Description of Artificial Sequence: Synthetic polypeptide
CPPNHFMCNSYDKCVPAHWFCDGVLDCLDSSDETNCGGGGSGGGGSCPAYTEFLCADSDACFPSEWACDGEMDCVDGSDELHCGGGG

SEQ ID NO: 388 - protein, 88 aa, Artificial Sequence
  Description of Artificial Sequence: Synthetic polypeptide
CPPNHFMCNSYDKCVPAHWFCDGVLDCLDSSDETNCSAPASEPPGSLCPAYTEFLCKDSDRCFPSEWRCDGEMDCVDGSDELHCAYHT

SEQ ID NO: 389 - protein, 87 aa, Artificial Sequence
  Description of Artificial Sequence: Synthetic polypeptide
CGADHFACASYDKCVPAHWLCDGVLDCLDSSDETYCGGGGSGGGGSCPAYTEFLCADSDACFPSEWACDGEMDCVDGSDELHCGGGG

SEQ ID NO: 390 - protein, 87 aa, Artificial Sequence
  Description of Artificial Sequence: Synthetic polypeptide
CGADHFRCASYDKCVPAHWLCDGVLDCLDSSDETYCGGGGSGGGGSCPAYTEFLCADSDACFPSEWACDGEMDCVDGSDELHCGGGG

SEQ ID NO: 391 - protein, 87 aa, Artificial Sequence
  Description of Artificial Sequence: Synthetic polypeptide
CGADHFACRSYDKCVPAHWLCDGVLDCLDSSDETYCGGGGSGGGGSCPAYTEFLCADSDACFPSEWACDGEMDCVDGSDELHCGGGG

SEQ ID NO: 392 - protein, 82 aa, Artificial Sequence
  Description of Artificial Sequence: Synthetic polypeptide
CPAGQFTCGNGHCIPLPWLCDGANDCGDGSDEAPQCEAAAPACGSAEFPCQGPDICLPPEWICDGDDDCLETSDEAYCGGGG

SEQ ID NO: 393 - protein, 82 aa, Artificial Sequence
  Description of Artificial Sequence: Synthetic polypeptide
CPAGQFTCGNGHCIPLPWLCDGANDCGDGSDEAPQCGGGGAGCGSAEFPCQGPDICLPPEWICDGDDDCLETSDEAYCGGGG

SEQ ID NO: 394 - protein, 78 aa, Artificial Sequence
  Description of Artificial Sequence: Synthetic polypeptide
CPAGQFTCGNGHCIPLPWLCDGANDCGDGSDEAPQCEAAAPACGSAEFPCQGPDICLPPEWICDGDDDCLETSDEAYC

SEQ ID NO: 395 - protein, 78 aa, Artificial Sequence
  Description of Artificial Sequence: Synthetic polypeptide
CPAGQFTCGNGHCIPLPWLCDGANDCGDGSDEAPQCGGGGAGCGSAEFPCQGPDICLPPEWICDGDDDCLETSDEAYC

SEQ ID NO: 396 - protein, 82 aa, Artificial Sequence
  Description of Artificial Sequence: Synthetic polypeptide
CPSGQFTCGNGYCIPEEWVCDGVDDCGDGSDEPPLCEAAVPACGSAEFPCQGTDICLPPEWICDGDDDCLDTPDEAYCGGGG

SEQ ID NO: 397 - protein, 82 aa, Artificial Sequence
  Description of Artificial Sequence: Synthetic polypeptide
CPSGQFTCGNGYCIPEEWVCDGVDDCGDGSDEPPLCGGGGAGCGSAEFPCQGTDICLPPEWICDGDDDCLDTPDEAYCGGGG

SEQ ID NO: 398 - protein, 78 aa, Artificial Sequence
  Description of Artificial Sequence: Synthetic polypeptide
CPSGQFTCGNGYCIPEEWVCDGVDDCGDGSDEPPLCEAAVPACGSAEFPCQGTDICLPPEWICDGDDDCLDTPDEAYC

SEQ ID NO: 399 - protein, 78 aa, Artificial Sequence
  Description of Artificial Sequence: Synthetic polypeptide
CPSGQFTCGNGYCIPEEWVCDGVDDCGDGSDEPPLCGGGGAGCGSAEFPCQGTDICLPPEWICDGDDDCLDTPDEAYC

SEQ ID NO: 400 - protein, 81 aa, Artificial Sequence
  Description of Artificial Sequence: Synthetic polypeptide
CPAYTEFLCADSDACFPSEWACDGEMDCVDGSDELHCGGGGCAPNQFACNSYDACVPAHWVCDGVLDCLDSSDETNCGGGG

SEQ ID NO: 401 - protein, 81 aa, Artificial Sequence
  Description of Artificial Sequence: Synthetic polypeptide
CPAYTEFLCADSDACFPSEWRCDGEMDCVDGSDELHCGGGGCAPNQFACNSYDKCVPAHWVCDGVLDCLDSSDETNCGGGG

SEQ ID NO: 402 - protein, 87 aa, Artificial Sequence; identical to SEQ ID NO: 380
  Description of Artificial Sequence: Synthetic polypeptide

SEQ ID NO: 403 - protein, 87 aa, Artificial Sequence; identical to SEQ ID NO: 382
  Description of Artificial Sequence: Synthetic polypeptide

SEQ ID NO: 404 - protein, 87 aa, Artificial Sequence; identical to SEQ ID NO: 384
  Description of Artificial Sequence: Synthetic polypeptide

SEQ ID NO: 405 - protein, 87 aa, Artificial Sequence; identical to SEQ ID NO: 387
  Description of Artificial Sequence: Synthetic polypeptide

SEQ ID NO: 406 - protein, 87 aa, Artificial Sequence; identical to SEQ ID NO: 389
  Description of Artificial Sequence: Synthetic polypeptide

SEQ ID NO: 407 - protein, 87 aa, Artificial Sequence; identical to SEQ ID NO: 390
  Description of Artificial Sequence: Synthetic polypeptide

SEQ ID NO: 408 - protein, 77 aa, Artificial Sequence
  Description of Artificial Sequence: Synthetic polypeptide
CPAYTEFLCADSDACFPSEWACDGEMDCVDGSDELHCGGGGCAPNQFACNSYDACVPAHWVCDGVLDCLDSSDETNC

SEQ ID NO: 409 - protein, 77 aa, Artificial Sequence
  Description of Artificial Sequence: Synthetic polypeptide
CPAYTEFLCADSDACFPSEWRCDGEMDCVDGSDELHCGGGGCAPNQFACNSYDKCVPAHWVCDGVLDCLDSSDETNC

SEQ ID NO: 410 - protein, 83 aa, Artificial Sequence
  Description of Artificial Sequence: Synthetic polypeptide
CAPNQFRCNSYDKCVPAHWVCDGVLDCLDSSDETNCGGGGSGGGGSCPAYTEFLCADSDRCFPSEWACDGEMDCVDGSDELHC

SEQ ID NO: 411 - protein, 83 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCADSDACFPSEWACDGEMDCVDGSDELHC

SEQ ID NO: 412 - protein, 83 aa, Artificial Sequence
  Description of Artificial Sequence: Synthetic polypeptide
CAPNQFACNSYDKCVPAHWVCDGVLDCLDSSDETNCGGGGSGGGGSCPAYTEFLCADSDRCFPSEWACDGEMDCVDGSDELHC

SEQ ID NO: 413 - protein, 83 aa, Artificial Sequence
  Description of Artificial Sequence: Synthetic polypeptide
CPPNHFMCNSYDKCVPAHWFCDGVLDCLDSSDETNCGGGGSGGGGSCPAYTEFLCADSDACFPSEWACDGEMDCVDGSDELHC

SEQ ID NO: 414 - protein, 83 aa, Artificial Sequence
  Description of Artificial Sequence: Synthetic polypeptide
CGADHFACASYDKCVPAHWLCDGVLDCLDSSDETYCGGGGSGGGGSCPAYTEFLCADSDACFPSEWACDGEMDCVDGSDELHC

SEQ ID NO: 415 - protein, 83 aa, Artificial Sequence
  Description of Artificial Sequence: Synthetic polypeptide
CGADHFRCASYDKCVPAHWLCDGVLDCLDSSDETYCGGGGSGGGGSCPAYTEFLCADSDACFPSEWACDGEMDCVDGSDELHC

SEQ ID NO: 416 - protein, 491 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCGSYEFPCQGTDICLLPAWLCDGDADCRYYSDETDCSQDPEFHAV

SEQ ID NO: 417 - protein, 495 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCGSYEFPCQGTDICLLPAWLCDGDADCRYYSDETDCSQDPEFHAVGPP

SEQ ID NO: 418 - protein, 525 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCPAGQFTCGNGHCIPLPWLCDGANDCGDGSDEAPQCGGGGAGCGSAEFPCQGPDICLPPEWICDGDDDCLETSDEAYC

SEQ ID NO: 419 - protein, 297 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGGGGAGCPAGQFTCGNGHCIPLPWLCDGANDCGDGSDEAPQCGGGGAGCGSAEFPCQGPDICLPPEWICDGDDDCLETSDEAYC

SEQ ID NO: 420 - protein, 525 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCPSGQFTCGNGYCIPEEWVCDGVDDCGDGSDEPPLCEAAVPACGSAEFPCQGTDICLPPEWICDGDDDCLDTPDEAYC

SEQ ID NO: 421 - protein, 297 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGGGGAGCPSGQFTCGNGYCIPEEWVCDGVDDCGDGSDEPPLCEAAVPACGSAEFPCQGTDICLPPEWICDGDDDCLDTPDEAYC

SEQ ID NO: 422 - protein, 299 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCADSDACFPSEWRCDGEMDCVDGSDELHCGGGGCAPNQFACNSYDKCVPAHWVCDGVLDCLDSSDETNCGGGG

SEQ ID NO: 423 - protein, 295 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCADSDACFPSEWACDGEMDCVDGSDELHCGGGGCAPNQFACNSYDACVPAHWVCDGVLDCLDSSDETNC

SEQ ID NO: 424 - protein, 523 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCPAYTEFLCADSDACFPSEWACDGEMDCVDGSDELHCGGGGCAPNQFACNSYDACVPAHWVCDGVLDCLDSSDETNC

SEQ ID NO: 425 - protein, 533 aa, Artificial Sequence
  Description of Artificial Sequence: Synthetic polypeptide
SSGGSCPAYTEFLCADSDACFPSEWACDGEMDCVDGSDELHCGGGGCAPNQFACNSYDACVPAHWVCDGVLDCLDSSDETNCGGGGSGGGGSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 426 - protein, 527 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCPAYTEFLCADSDACFPSEWRCDGEMDCVDGSDELHCGGGGCAPNQFACNSYDKCVPAHWVCDGVLDCLDSSDETNCGGGG

SEQ ID NO: 427 - protein, 533 aa, Artificial Sequence
  Description of Artificial Sequence: Synthetic polypeptide
SSGGSCPAYTEFLCADSDACFPSEWRCDGEMDCVDGSDELHCGGGGCAPNQFACNSYDKCVPAHWVCDGVLDCLDSSDETNCGGGGSGGGGSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 428 - protein, 534 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCAPNQFACNSYDKCVPAHWVCDGVLDCLDSSDETNCGGGGSGGGGSCPAYTEFLCADSDACFPSEWACDGEMDCVDGSDELHCGGGG

SEQ ID NO: 429 - protein, 534 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCAPNQFACNSYDKCVPAHWVCDGVLDCLDSSDETNCGGGGSGGGGSCPAYTEFLCADSDRCFPSEWACDGEMDCVDGSDELHCGGGG

SEQ ID NO: 430 - protein, 530 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCAPNQFRCNSYDKCVPAHWVCDGVLDCLDSSDETNCGGGGSGGGGSCPAYTEFLCADSDRCFPSEWACDGEMDCVDGSDELHC

SEQ ID NO: 431 - protein, 533 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCGADHFRCASYDKCVPAHWLCDGVLDCLDSSDETYCGGGGSGGGGSCPAYTEFLCADSDACFPSEWACDGEMDCVDGSDELHCGGGG

SEQ ID NO: 432 - protein, 530 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGAGCGADHFACASYDKCVPAHWLCDGVLDCLDSSDETYCGGGGSGGGGSCPAYTEFLCADSDACFPSEWACDGEMDCVDGSDELHC

SEQ ID NO: 433 - protein, 529 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCPPNHFMCNSYDKCVPAHWFCDGVLDCLDSSDETNCGGGGSGGGGSCPAYTEFLCADSDACFPSEWACDGEMDCVDGSDELHC

SEQ ID NO: 434 - protein, 533 aa, Artificial Sequence
  Description of Artificial Sequence: Synthetic polypeptide
SSGGSCPPNHFMCNSYDKCVPAHWFCDGVLDCLDSSDETNCGGGGSGGGGSCPAYTEFLCADSDACFPSEWACDGEMDCVDGSDELHCGGGGQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 435 - protein, 537 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCAPNQFRCNSYDKCVPAHWVCDGVLDCLDSSDETNCSAPASEPPGSLCPAYTEFLCKDSDRCFPSEWRCDGEMDCVDGSDELHCAYHTSLQ

SEQ ID NO: 436 - protein, 537 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSSGGSCGRDHFRCRSYDKCVPAHWLCDGVLDCLDSSDETYCSAPASEPPGSLCPAYTEFLCKDSDRCFPSEWRCDGEMDCVDGSDELHCAYHTSLQ

SEQ ID NO: 437 - protein, 538 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCAPNQFRCNSYDKCVPAHWVCDGVLDCLDSSDETNCSAPASEPPGSLCPAYTEFLCADSDRCFPSEWRCDGEMDCVDGSDELHCAYHTSLQ

SEQ ID NO: 438 - protein, 309 aa, Artificial Sequence
  Description of Artificial Sequence: Synthetic polypeptide
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSSSGGSCPAYTEFLCADSDRCFPSEWRCDGEMDCVDGSDELHCAYHTCAPNQFRCNSYDKCVPAHWVCDGVLDCLDSSDETNCSAPASEPPGSLSLQ

SEQ ID NO: 439 - protein, 535 aa, Artificial Sequence
  Description of Artificial Sequence: Synthetic polypeptide
SGGSCPAYTEFLCADSDACFPSEWACDGEMDCVDGSDELHCAYHTCAPNQFACNSYDACVPAHWVCDGVLDCLDSSDETNCSAPASEPPGSLSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 440 - protein, 538 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCAPNQFACNSYDKCVPAHWVCDGVLDCLDSSDETNCSAPASEPPGSLCPAYTEFLCADSDACFPSEWACDGEMDCVDGSDELHCAYHTSLQ

SEQ ID NO: 441 - protein, 533 aa, Artificial Sequence
  Description of Artificial Sequence: Synthetic polypeptide
SGGSCPAYTEFLCKDSDRCFPSEWRCDGEMDCVDGSDELHCGGGGCAPNQFRCNSYDKCVPAHWVCDGVLDCLDSSDETNCGGGGSGGGGSQVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 442 - protein, 530 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKSSGGSCAPNQFRCNSYDKCVPAHWVCDGVLDCLDSSDETNCGGGGSGGGGSCPAYTEFLCKDSDRCFPSEWRCDGEMDCVDGSDELHC

SEQ ID NO: 443 - protein, 42 aa, Artificial Sequence
  Description of Artificial Sequence: Synthetic polypeptide
CEAFGAFRCRSTGRCIPSEFVCDGDNDCDDGSDEPPFCPYRT

SEQ ID NO: 444 - protein, 42 aa, Artificial Sequence
  Description of Artificial Sequence: Synthetic polypeptide
CPAPIAFLCGDGTCIPKEWKCDGEWDCADGSDEAPATCPYRT

SEQ ID NO: 445 - protein, 40 aa, Artificial Sequence
  Description of Artificial Sequence: Synthetic polypeptide
CPASYFQCRNNNHCYPMEWRCDGFQDCEDGSDEKGCPYRT

SEQ ID NO: 446 - protein, 39 aa, Artificial Sequence
  Description of Artificial Sequence: Synthetic polypeptide
CPSNEFMCADKMCFPLIFLCDGENDCEDGSDEVDCPSRT

SEQ ID NO: 447 - protein, 40 aa, Artificial Sequence
  Description of Artificial Sequence: Synthetic polypeptide
CPASYFKCRKHNHCYPMEWRCDGFQDCEDGSDEQACPYRT

SEQ ID NO: 448 - protein, 40 aa, Artificial Sequence
  Description of Artificial Sequence: Synthetic polypeptide
CPASYFKCRNYNHCYPMEWRCDGFRDCEDGSDEEGCPYRT

SEQ ID NO: 449 - protein, 40 aa, Artificial Sequence
  Description of Artificial Sequence: Synthetic polypeptide
CPASYFQCGNLNHCYPMEWRCDGFQDCVDGSDEKGCPYRT

SEQ ID NO: 450 - protein, 40 aa, Artificial Sequence
  Description of Artificial Sequence: Synthetic polypeptide
CPASYFQCGNYKHCYPMEWHCDGFQDCVDGSDEKACPYRT

SEQ ID NO: 451 - protein, 40 aa, Artificial Sequence
  Description of Artificial Sequence: Synthetic polypeptide
CPASYFQCGNYNHCYPMEWRCDGFLDCVDGSDEKGCPYRT

SEQ ID NO: 452 - protein, 40 aa, Artificial Sequence
  Description of Artificial Sequence: Synthetic polypeptide
CPASYFQCGNINHCYPVEWRCDGFQDCDDGSDEYVCPYRT

SEQ ID NO: 453 - protein, 40 aa, Artificial Sequence
  Description of Artificial Sequence: Synthetic polypeptide
CPASYFQCRNHPHCYPMEWRCDGFPDCVDGSDEKGCPYRT

SEQ ID NO: 454 - protein, 40 aa, Artificial Sequence
  Description of Artificial Sequence: Synthetic polypeptide
CPASYFQCGSHPHCYPMEWRCDGFQDCEDGSDELGCPYRT

SEQ ID NO: 455 - protein, 40 aa, Artificial Sequence
  Description of Artificial Sequence: Synthetic polypeptide
CPASYFQCLKHPHCYPMEWRCDGFDDCEDGSDETGCPYRT

SEQ ID NO: 456 - protein, 40 aa, Artificial Sequence
  Description of Artificial Sequence: Synthetic polypeptide
CPASYFQCMNHNHCYPMEWRCDGFPDCEDGSDEKGCPYRT

SEQ ID NO: 457 - protein, 40 aa, Artificial Sequence
  Description of Artificial Sequence: Synthetic polypeptide
CPASYFQCRHHNHCYPMEWRCDGFHDCVDGSDEIGCPYRT

SEQ ID NO: 458 - protein, 40 aa, Artificial Sequence
  Description of Artificial Sequence: Synthetic polypeptide
CPASYFQCRNNNSCYPMEWRCDGFEDCEDGSDERGCPYRT

SEQ ID NO: 459 - protein, 40 aa, Artificial Sequence
  Description of Artificial Sequence: Synthetic polypeptide
CPASYFQCRNYNHCYPMEWRCDGFEDCLDGSDETDCPYRT

SEQ ID NO: 460 - protein, 40 aa, Artificial Sequence
  Description of Artificial Sequence: Synthetic polypeptide
CPASYFQCWNFKHCYPMEWRCDGFNDCVDGSDEKGCPYRT

SEQ ID NO: 461 - protein, 40 aa, Artificial Sequence
  Description of Artificial Sequence: Synthetic polypeptide
CPASYFQCRHNKHCYPMEWRCDGFPDCEDGSDELSCPYRT

SEQ ID NO: 462 - protein, 40 aa, Artificial Sequence
  Description of Artificial Sequence: Synthetic polypeptide
CPASYFRCRNHNHCYPMEWRCDGFDDCEDGSDEQGCPYRT

SEQ ID NO: 463 - protein, 40 aa, Artificial Sequence
  Description of Artificial Sequence: Synthetic polypeptide
CPASYFRCRNRNHCYPMEWRCDGFPDCEDASDEKGCPYRT

SEQ ID NO: 464 - protein, 40 aa, Artificial Sequence
  Description of Artificial Sequence: Synthetic polypeptide
CPESYFQCREYKHCYPMEWRCDGFPDCVDGSDEDFCPYRT

SEQ ID NO: 465 - protein, 40 aa, Artificial Sequence
  Description of Artificial Sequence: Synthetic polypeptide
CPPSYFQCGNINHCYPMEWRCDGFHDCVDGSDEQGCPYRT

SEQ ID NO: 466 - protein, 40 aa, Artificial Sequence
  Description of Artificial Sequence: Synthetic polypeptide
CPVSYFKCRHRNHCYPMEWRCDGFPDCDDGSDERGCPYRT

SEQ ID NO: 467 - protein, 40 aa, Artificial Sequence
  Description of Artificial Sequence: Synthetic polypeptide
CPVSYFKCRNKNHCYPMEWRCDGFPDCEDGSDEKGCPYRT

SEQ ID NO: 468 - protein, 40 aa, Artificial Sequence
  Description of Artificial Sequence: Synthetic polypeptide
CPVSYFQCRIYNHCYPMEWRCDGFEDCVDGSDEKGCPYRT

SEQ ID NO: 469 - protein, 40 aa, Artificial Sequence
  Description of Artificial Sequence: Synthetic polypeptide
CPVSYFQCRYHNHCYPMEWRCDGFPDCEDASDEEGCPYRT

SEQ ID NO: 470 - protein, 40 aa, Artificial Sequence
  Description of Artificial Sequence: Synthetic polypeptide
CPVSYFRCRHLNHCYPMEWRCDGFLDCVDGSDEEGCPYRT

SEQ ID NO: 471 - protein, 39 aa, Artificial Sequence
  Description of Artificial Sequence: Synthetic polypeptide
CPLNEFMCPDKMCFPLIFLCDGENDCHDGSDEAYCPSRT

SEQ ID NO: 472 - protein, 39 aa, Artificial Sequence
  Description of Artificial Sequence: Synthetic polypeptide
CPQNEFMCADKTCFPFSFLCDGDIDCYDGSDEAYCPSRT

SEQ ID NO: 473 - protein, 39 aa, Artificial Sequence
  Description of Artificial Sequence: Synthetic polypeptide
CPRNEFMCADKMCFPVSFLCDGENDCEDGSDEDYCPSRT

SEQ ID NO: 474 - protein, 39 aa, Artificial Sequence
  Description of Artificial Sequence: Synthetic polypeptide
CPSNEFMCADKICFPLSFLCDGENDCLDGSDEDYCPSRT

SEQ ID NO: 475 - protein, 39 aa, Artificial Sequence
  Description of Artificial Sequence: Synthetic polypeptide
CPSNEFMCADKVCFPWSFLCDGDNDCEDGSDELYCPSRT

SEQ ID NO: 476 - protein, 39 aa, Artificial Sequence
  Description of Artificial Sequence: Synthetic polypeptide
CPSNEFMCPDKICFPLSFLCDGENDCEDGSDEDYCPSRT

SEQ ID NO: 477 - protein, 39 aa, Artificial Sequence
  Description of Artificial Sequence: Synthetic polypeptide
CPSNEFMCPDKMCFPLSFLCDGENDCYDGSDEEDCPSRT

SEQ ID NO: 478 - protein, 39 aa, Artificial Sequence
  Description of Artificial Sequence: Synthetic polypeptide
CPSNEFMCPDKMCFPLSFRCDGENDCEDGSDELYCPSRT

SEQ ID NO: 479 - protein, 39 aa, Artificial Sequence
  Description of Artificial Sequence: Synthetic polypeptide
CPSYEFMCADKMCFPLDFLCDGENDCEDGSDEDYCPSRT

SEQ ID NO: 480 - protein, 39 aa, Artificial Sequence
  Description of Artificial Sequence: Synthetic polypeptide
CPSYEFMCADKMCFPLSFLCDGENDCEDGSDEDYCPSRT

SEQ ID NO: 481 - protein, 39 aa, Artificial Sequence
  Description of Artificial Sequence: Synthetic polypeptide
CPSYEFMCPDKVCFPLSFLCDGENDCQDGSDEDYCPSRT

SEQ ID NO: 482 - protein, 39 aa, Artificial Sequence
  Description of Artificial Sequence: Synthetic polypeptide
CPSNEFMCPDKVCFPWSFLCDGDNDCQDGSDEEYCGGGG

SEQ ID NO: 483 - protein, 39 aa, Artificial Sequence
  Description of Artificial Sequence: Synthetic polypeptide
CPSNEFMCPDKVCFPWSFLCDGDNDCEDGSDELFCGGGG

SEQ ID NO: 484 - protein, 39 aa, Artificial Sequence
  Description of Artificial Sequence: Synthetic polypeptide
CPSNEFMCADQVCFPWSFLCDGENDCEDGSDELYCGGGG

SEQ ID NO: 485 - protein, 40 aa, Artificial Sequence
  Description of Artificial Sequence: Synthetic polypeptide
CPAPYFQCRNDPPCHPMDWRCDGFPDCVDGSDEKGCGGGG

SEQ ID NO: 486 - protein, 40 aa, Artificial Sequence
  Description of Artificial Sequence: Synthetic polypeptide
CPASYFKCRNHPHCYPMEWRCDGFADCLDGSDESGCGGGG

SEQ ID NO: 487 - protein, 40 aa, Artificial Sequence
  Description of Artificial Sequence: Synthetic polypeptide
CPASYFKCRNHPHCYPMEWRCDGFADCVDGSDELSCGGGG

SEQ ID NO: 488 - protein, 40 aa, Artificial Sequence
  Description of Artificial Sequence: Synthetic polypeptide
CPASYFKCRNHPHCYPMEWRCDGFPDCIDGSDETACGGGG

SEQ ID NO: 489 - protein, 40 aa, Artificial Sequence
  Description of Artificial Sequence: Synthetic polypeptide
CPASYFKCRYHPHCYPMEWRCDGFSDCVDGSDEEACGGGG

SEQ ID NO: 490 - protein, 40 aa, Artificial Sequence
  Description of Artificial Sequence: Synthetic polypeptide
CPASYFQCGNLPHCYPMEWRCDGFPDCIDGSDEKGCGGGG

SEQ ID NO: 491 - protein, 40 aa, Artificial Sequence
  Description of Artificial Sequence: Synthetic polypeptide
CPASYFQCRKHPHCYPMEWRCDGFPDCIDGSDEERCGGGG

SEQ ID NO: 492 - protein, 40 aa, Artificial Sequence
  Description of Artificial Sequence: Synthetic polypeptide
CPASYFQCRNHPHCYPMEWRCDGFPDCLDGSDETDCGGGG

SEQ ID NO: 493 - protein, 40 aa, Artificial Sequence
  Description of Artificial Sequence: Synthetic polypeptide
CPASYFQCRNHPHCYPMEWRCDGFADCIDASDEIGCGGGG

SEQ ID NO: 494 - protein, 40 aa, Artificial Sequence
  Description of Artificial Sequence: Synthetic polypeptide
CPASYFQCRNHPHCYPMEWRCDGFEDCIDGSDEDNCGGGG

SEQ ID NO: 495 - protein, 40 aa, Artificial Sequence
  Description of Artificial Sequence: Synthetic polypeptide
CPASYFQCRNHPHCYPMEWRCDGFEDCIDGSDETSCGGGG

SEQ ID NO: 496 - protein, 40 aa, Artificial Sequence
  Description of Artificial Sequence: Synthetic polypeptide
CPASYFQCRNHPHCYPMEWRCDGFPDCIDGSDEESCGGGG

SEQ ID NO: 497 - protein, 40 aa, Artificial Sequence
  Description of Artificial Sequence: Synthetic polypeptide
CPASYFQCRNHPHCYPMEWRCDGFPDCIDGSDEQGCGGGG

SEQ ID NO: 498 - protein, 40 aa, Artificial Sequence
  Description of Artificial Sequence: Synthetic polypeptide
CPASYFQCRRHPHCYPMEWRCDGFPDCLDGSDEEGCGGGG

SEQ ID NO: 499 - protein, 40 aa, Artificial Sequence
  Description of Artificial Sequence: Synthetic polypeptide
CPASYFRCRNHPHCYPMEWRCDGFEDCVDGSDELDCGGGG

SEQ ID NO: 500 - protein, 40 aa, Artificial Sequence
  Description of Artificial Sequence: Synthetic polypeptide
CPATYFPCRNHPHCYPMEWRCDGFPDCIDESDEMGCGGGG

SEQ ID NO: 501 - protein, 40 aa, Artificial Sequence
  Description of Artificial Sequence: Synthetic polypeptide
CPESYFQCREYKHCYPMEWRCDGFPDCIDSSDETDCGGGG

SEQ ID NO: 502 - protein, 40 aa, Artificial Sequence
  Description of Artificial Sequence: Synthetic polypeptide
CPESYFQCRNHPHCYPMEWRCDGFEDCVDGSDELDCGGGG

SEQ ID NO: 503 - protein, 40 aa, Artificial Sequence
  Description of Artificial Sequence: Synthetic polypeptide
CPESYFQCRNHPHCYPMEWRCDGFPDCVDGSDELDCGGGG

SEQ ID NO: 504 - protein, 40 aa, Artificial Sequence
  Description of Artificial Sequence: Synthetic polypeptide
CPVSYFQCRNHPHCYPMEWRCDGFPDCIDGSDEEGCGGGG

SEQ ID NO: 505 - protein, 40 aa, Artificial Sequence
  Description of Artificial Sequence: Synthetic polypeptide
CPVSYFQCRNHPHCYPMEWRCDGFPDCLDESDEKGCGGGG

SEQ ID NO: 506 - protein, 40 aa, Artificial Sequence
  Description of Artificial Sequence: Synthetic polypeptide
CPVSYFQCRNHPHCYPMEWRCDGFPDCVDASDEIGCGGGG

SEQ ID NO: 507 - protein, 79 aa, Artificial Sequence
  Description of Artificial Sequence: Synthetic polypeptide
CRSNEFRCNNGHCIPADWVCDGEDDCEDNSDEANCGGGGCPASYFQCGNLPHCYPMEWRCDGFPDCIDGSDEKGCGGGG

SEQ ID NO: 508 - protein, 82 aa, Artificial Sequence
  Description of Artificial Sequence: Synthetic polypeptide
CHSPSEFECSSGNCIPAGWVCDGVDDCQDDSDESLDLCGGGGCPASYFQCGNLPHCYPMEWRCDGFPDCIDGSDEKGCGGGG

SEQ ID NO: 509 - protein, 80 aa, Artificial Sequence
  Description of Artificial Sequence: Synthetic polypeptide
CLSSEFPCKDSGKCVPRRLLCDGVDDCGDNSDEAGCGGGGCPASYFQCGNLPHCYPMEWRCDGFPDCIDGSDEKGCGGGG

SEQ ID NO: 510 - protein, 80 aa, Artificial Sequence
  Description of Artificial Sequence: Synthetic polypeptide
CESSDEFKCDSGNCIPLAWGCDGEDDCGDGSDEASCGGGGCPASYFQCGNLPHCYPMEWRCDGFPDCIDGSDEKGCGGGG

SEQ ID NO: 511 - protein, 81 aa, Artificial Sequence
  Description of Artificial Sequence: Synthetic polypeptide
CQSDEFRCSSGQCIPQHWLCDGENDCGDDSDESSAICGGGGCPASYFQCGNLPHCYPMEWRCDGFPDCIDGSDEKGCGGGG

SEQ ID NO: 512 - protein, 79 aa, Artificial Sequence
  Description of Artificial Sequence: Synthetic polypeptide
CVPSEFRCDNGQCIPLNWLCDGVNDCVDGSDETDCGGGGCPASYFQCGNLPHCYPMEWRCDGFPDCIDGSDEKGCGGGG

SEQ ID NO: 513 - protein, 81 aa, Artificial Sequence
  Description of Artificial Sequence: Synthetic polypeptide
CLSSQFRCGNGRCIPAHLLCDGVDDCQDDSDESPALCGGGGCPASYFQCGNLPHCYPMEWRCDGFPDCIDGSDEKGCGGGG

SEQ ID NO: 514 - protein, 81 aa, Artificial Sequence
  Description of Artificial Sequence: Synthetic polypeptide
CLAGQFPCSNGQCISAQWVCDGVPDCEDNSDESSEICGGGGCPASYFQCGNLPHCYPMEWRCDGFPDCIDGSDEKGCGGGG

SEQ ID NO: 515 - protein, 80 aa, Artificial Sequence
  Description of Artificial Sequence: Synthetic polypeptide
CQSNEFKCNNGKCIPASWVCDGVNDCGDNSDEAAVCGGGGCPASYFQCGNLPHCYPMEWRCDGFPDCIDGSDEKGCGGGG

SEQ ID NO: 516 - protein, 81 aa, Artificial Sequence
  Description of Artificial Sequence: Synthetic polypeptide
CQSNQFQCDNGNCIPVEWVCDGVNDCRDGSDESSELCGGGGCPASYFQCGNLPHCYPMEWRCDGFPDCIDGSDEKGCGGGG

SEQ ID NO: 517 - protein, 79 aa, Artificial Sequence
  Description of Artificial Sequence: Synthetic polypeptide
CQSDEFRCGSGNCLPPTLVCDGDDDCGDNSDETGCGGGGCPASYFQCGNLPHCYPMEWRCDGFPDCIDGSDEKGCGGGG

SEQ ID NO: 518 - protein, 79 aa, Artificial Sequence
  Description of Artificial Sequence: Synthetic polypeptide
CVASQFTCGNGNCLSPTWLCDGVNDCGDNSDETNCGGGGCPASYFQCGNLPHCYPMEWRCDGFPDCIDGSDEKGCGGGG

SEQ ID NO: 519 - protein, 81 aa, Artificial Sequence
  Description of Artificial Sequence: Synthetic polypeptide
CRANEFQCGNGQCVPQALLCDGVNDCGDGSDESSALCGGGGCPASYFQCGNLPHCYPMEWRCDGFPDCIDGSDEKGCGGGG

SEQ ID NO: 520 - protein, 81 aa, Artificial Sequence
  Description of Artificial Sequence: Synthetic polypeptide
CQSSQFRCNSGQCIPQGWVCDGENDCADSSDESPALCGGGGCPASYFQCGNLPHCYPMEWRCDGFPDCIDGSDEKGCGGGG

SEQ ID NO: 521 - protein, 80 aa, Artificial Sequence
  Description of Artificial Sequence: Synthetic polypeptide
CESSEFRCSNGRCIPAGWVCDGVNDCVDNSDESEQCGGGGCPASYFQCGNLPHCYPMEWRCDGFPDCIDGSDEKGCGGGG

SEQ ID NO: 522 - protein, 81 aa, Artificial Sequence
  Description of Artificial Sequence: Synthetic polypeptide
CQSNEFRCGSGHCIPLTLLCDGEDDCPDGSDESPEICGGGGCPASYFQCGNLPHCYPMEWRCDGFPDCIDGSDEKGCGGGG

SEQ ID NO: 523 - protein, 81 aa, Artificial Sequence
  Description of Artificial Sequence: Synthetic polypeptide
CPASQFRCNSGQCIPPHWVCDGVDDCGDGSDEASALCGGGGCPASYFQCGNLPHCYPMEWRCDGFPDCIDGSDEKGCGGGG

SEQ ID NO: 524 - protein, 80 aa, Artificial Sequence
  Description of Artificial Sequence: Synthetic polypeptide
CGAGEFPCDNGNCIPPQLVCDGEDDCGDGSDESQVCGGGGCPASYFQCGNLPHCYPMEWRCDGFPDCIDGSDEKGCGGGG

SEQ ID NO: 525 - protein, 81 aa, Artificial Sequence
  Description of Artificial Sequence: Synthetic polypeptide
CASGEFQCGSGNCIPQKWLCDGVNDCGDGSDESLDLCGGGGCPASYFQCGNLPHCYPMEWRCDGFPDCIDGSDEKGCGGGG

SEQ ID NO: 526 - protein, 82 aa, Artificial Sequence
  Description of Artificial Sequence: Synthetic polypeptide
CASNQFTCKSNGTCVPLHWVCDGENDCVDGSDEALENCGGGGCPASYFQCGNLPHCYPMEWRCDGFPDCIDGSDEKGCGGGG

SEQ ID NO: 527 - protein, 81 aa, Artificial Sequence
  Description of Artificial Sequence: Synthetic polypeptide
CGPSEFPCSNGSCIPPHLLCDGDDDCGDDSDEPLAPCGGGGCPASYFQCGNLPHCYPMEWRCDGFPDCIDGSDEKGCGGGG

SEQ ID NO: 528 - protein, 81 aa, Artificial Sequence
  Description of Artificial Sequence: Synthetic polypeptide
CQASEFKCDNGNCIPAGWVCDGVDDCGDGSDEAPATCGGGGCPASYFQCGNLPHCYPMEWRCDGFPDCIDGSDEKGCGGGG

SEQ ID NO: 529 - protein, 81 aa, Artificial Sequence
  Description of Artificial Sequence: Synthetic polypeptide
CGSSQFTCDNGNCISESWLCDGVNDCGDDSDESLAICGGGGCPASYFQCGNLPHCYPMEWRCDGFPDCIDGSDEKGCGGGG

SEQ ID NO: 530 - protein, 79 aa, Artificial Sequence
  Description of Artificial Sequence: Synthetic polypeptide
CAPDEFRCENGRCIPGEWRCDGDNDCGDDSDETGCGGGGCPASYFQCGNLPHCYPMEWRCDGFPDCIDGSDEKGCGGGG

SEQ ID NO: 531 - protein, 79 aa, Artificial Sequence
  Description of Artificial Sequence: Synthetic polypeptide
CQPDEFRCNNGRCVPQPWHCDGDDDCEDNSDETDCGGGGCPASYFQCGNLPHCYPMEWRCDGFPDCIDGSDEKGCGGGG

SEQ ID NO: 532 - protein, 79 aa, Artificial Sequence
  Description of Artificial Sequence: Synthetic polypeptide
CASGEFPCNNGSCIPAAWRCDGDDDCGDGSDEASCGGGGCPASYFQCGNLPHCYPMEWRCDGFPDCIDGSDEKGCGGGG

SEQ ID NO: 533 - protein, 80 aa, Artificial Sequence
  Description of Artificial Sequence: Synthetic polypeptide
CQPSEFPCDNGSCVPEALVCDGEPDCVDNSDESAVCGGGGCPASYFQCGNLPHCYPMEWRCDGFPDCIDGSDEKGCGGGG

SEQ ID NO: 534 - protein, 80 aa, Artificial Sequence
  Description of Artificial Sequence: Synthetic polypeptide
CLSGEFRCKNGRCIPLDWRCDGDNDCGDNSDEAEVCGGGGCPASYFQCGNLPHCYPMEWRCDGFPDCIDGSDEKGCGGGG

SEQ ID NO: 535 - protein, 81 aa, Artificial Sequence
  Description of Artificial Sequence: Synthetic polypeptide
CEPSEFKCGNGKCIPGRWLCDGEDDCGDGSDEASEHCGGGGCPASYFQCGNLPHCYPMEWRCDGFPDCIDGSDEKGCGGGG

SEQ ID NO: 536 - protein, 80 aa, Artificial Sequence
  Description of Artificial Sequence: Synthetic polypeptide
CPPGEFTCSNGKCIPGHWVCDGENDCADNSDEAEVCGGGGCPASYFQCGNLPHCYPMEWRCDGFPDCIDGSDEKGCGGGG

SEQ ID NO: 537 - protein, 79 aa, Artificial Sequence
  Description of Artificial Sequence: Synthetic polypeptide
CESGEFKCSNGSCIPEEWRCDGENDCPDGSDEKSCGGGGCPASYFQCGNLPHCYPMEWRCDGFPDCIDGSDEKGCGGGG

SEQ ID NO: 538 - protein, 81 aa, Artificial Sequence
  Description of Artificial Sequence: Synthetic polypeptide
CPSGQFPCRNGKCIPQRWLCDGDDDCGDSSDEAPELCGGGGCPASYFQCGNLPHCYPMEWRCDGFPDCIDGSDEKGCGGGG

SEQ ID NO: 539 - protein, 81 aa, Artificial Sequence
  Description of Artificial Sequence: Synthetic polypeptide
CQADEFKCKNGRCIPAGWVCDGVNDCGDGSDEAPALCGGGGCPASYFQCGNLPHCYPMEWRCDGFPDCIDGSDEKGCGGGG

SEQ ID NO: 540 - protein, 81 aa, Artificial Sequence
  Description of Artificial Sequence: Synthetic polypeptide
CQASEFTCNNGQCIPAGWVCDGVNDCGDNSDEASALCGGGGCPASYFQCGNLPHCYPMEWRCDGFPDCIDGSDEKGCGGGG

SEQ ID NO: 541 - protein, 80 aa, Artificial Sequence
  Description of Artificial Sequence: Synthetic polypeptide
CRANEFKCRNGKCVSAGWVCDGVDDCGDNSDEAEVCGGGGCPASYFKCRNHPHCYPMEWRCDGFPDCIDGSDETACGGGG

SEQ ID NO: 542 - protein, 80 aa, Artificial Sequence
  Description of Artificial Sequence: Synthetic polypeptide
CPASYFQCGNLPHCYPMEWRCDGFPDCIDGSDEKGCGGGGCAPSEFRCGNGRCIPGELLCDGVNDCLDNSDEAADCGGGG

SEQ ID NO: 543 - protein, 80 aa, Artificial Sequence
  Description of Artificial Sequence: Synthetic polypeptide
CPASYFQCGNLPHCYPMEWRCDGFPDCIDGSDEKGCGGGGCVPGEFRCDNGQCIPPHWLCDGEPDCRDNSDESELCGGGG

SEQ ID NO: 544 - protein, 80 aa, Artificial Sequence
  Description of Artificial Sequence: Synthetic polypeptide
CPASYFQCGNLPHCYPMEWRCDGFPDCIDGSDEKGCGGGGCHPTDQFECGNGHCISGRWVCDGVNDCGDNSDETDCGGGG

SEQ ID NO: 545 - protein, 80 aa, Artificial Sequence
  Description of Artificial Sequence: Synthetic polypeptide
CPASYFQCGNLPHCYPMEWRCDGFPDCIDGSDEKGCGGGGCPPDQFQCNSGNCIPGDWRCDGDNDCGDGSDESELCGGGG

SEQ ID NO: 546 - protein, 79 aa, Artificial Sequence
  Description of Artificial Sequence: Synthetic polypeptide
CPASYFQCGNLPHCYPMEWRCDGFPDCIDGSDEKGCGGGGCPPSEFQCGNGQCVPAHWVCDGEPDCEDGSDEADCGGGG

SEQ ID NO: 547 - protein, 80 aa, Artificial Sequence
  Description of Artificial Sequence: Synthetic polypeptide
CPASYFQCGNLPHCYPMEWRCDGFPDCIDGSDEKGCGGGGCPSSEFQCGNGKCIPERWLCDGDNDCGDNSDESPECGGGG

SEQ ID NO: 548 - protein, 82 aa, Artificial Sequence
  Description of Artificial Sequence: Synthetic polypeptide
CPASYFKCRNHPHCYPMEWRCDGFPDCIDGSDETACGGGGCHPTDQFECKSGQCIPGALGCDGVNDCEDGSDESPDLCGGGG

SEQ ID NO: 549 - protein, 79 aa, Artificial Sequence
  Description of Artificial Sequence: Synthetic polypeptide
CPASYFQCGNLPHCYPMEWRCDGFPDCIDGSDEKGCGGGGCPPSEFPCGNGQCVPVPWLCDGDNDCVDDSDEEDCGGGG

SEQ ID NO: 550 - protein, 81 aa, Artificial Sequence
  Description of Artificial Sequence: Synthetic polypeptide
CPASYFQCGNLPHCYPMEWRCDGFPDCIDGSDEKGCGGGGCEPFDKFECGSGHCVPLDWVCDGEDDCPDDSDEPQQCGGGG

SEQ ID NO: 551 - protein, 80 aa, Artificial Sequence
  Description of Artificial Sequence: Synthetic polypeptide
CPASYFQCGNLPHCYPMEWRCDGFPDCIDGSDEKGCGGGGCPPNEFQCGNGHCIPENLLCDGVPDCEDGSDEAAQCGGGG

SEQ ID NO: 552 - protein, 80 aa, Artificial Sequence
  Description of Artificial Sequence: Synthetic polypeptide
CPASYFQCGNLPHCYPMEWRCDGFPDCIDGSDEKGCGGGGCDPFNQFECKNGKCIPAHWRCDGDDDCGDNSDGADCGGGG

SEQ ID NO: 553 - protein, 79 aa, Artificial Sequence
  Description of Artificial Sequence: Synthetic polypeptide
CPASYFQCGNLPHCYPMEWRCDGFPDCIDGSDEKGCGGGGCPSDQFTCRSGSCIPATWRCDGENDCGDNSDEEDCGGGG

SEQ ID NO: 554 - protein, 79 aa, Artificial Sequence
  Description of Artificial Sequence: Synthetic polypeptide
CPASYFQCGNLPHCYPMEWRCDGFPDCIDGSDEKGCGGGGCQPNEFRCRSGSCIPLAWLCDGVDDCEDSSDEANCGGGG

SEQ ID NO: 555 - protein, 80 aa, Artificial Sequence
  Description of Artificial Sequence: Synthetic polypeptide
CPASYFQCGNLPHCYPMEWRCDGFPDCIDGSDEKGCGGGGCPSNQFQCKNGSCIPPSWVCDGVPDCEDNSDESEDCGGGG

SEQ ID NO: 556 - protein, 80 aa, Artificial Sequence
  Description of Artificial Sequence: Synthetic polypeptide
CPASYFQCGNLPHCYPMEWRCDGFPDCIDGSDEKGCGGGGCPSGEFPCNNGKCIPRAWLCDGEDDCGDGSDEPAQCGGGG

SEQ ID NO: 557 - protein, 80 aa, Artificial Sequence
  Description of Artificial Sequence: Synthetic polypeptide
CPASYFQCGNLPHCYPMEWRCDGFPDCIDGSDEKGCGGGGCPPDEFQCSNGNCIPPNWVCDGEDDCEDSSDESALCGGGG

SEQ ID NO: 558 - protein, 82 aa, Artificial Sequence
  Description of Artificial Sequence: Synthetic polypeptide
CPASYFQCGNLPHCYPMEWRCDGFPDCIDGSDEKGCGGGGCESDEFPCHNSDICIPGHWGCDGENDCQDDSDESSENCGGGG

SEQ ID NO: 559 - protein, 81 aa, Artificial Sequence
  Description of Artificial Sequence: Synthetic polypeptide
CPASYFQCGNLPHCYPMEWRCDGFPDCIDGSDEKGCGGGGCVPNQFKCGNGHCIPGHWVCDGEDDCGDNSDESPAHCGGGG

SEQ ID NO: 560 - protein, 78 aa, Artificial Sequence
  Description of Artificial Sequence: Synthetic polypeptide
CEPNQFKCKNGNSVPEHWVCDGEDDCGDGSDEANCGGGGCPSNEFMCPDKVCFPWSFLCDGDNDCQDGSDEEYCGGGG

SEQ ID NO: 561 - protein, 81 aa, Artificial Sequence
  Description of Artificial Sequence: Synthetic polypeptide
CHPTDQFECGNGRCISANWVCDGEDDCGDGSDESPDLCGGGGCPSNEFMCPDKVCFPWSFLCDGDNDCQDGSDEEYCGGGG

SEQ ID NO: 562 - protein, 79 aa, Artificial Sequence
  Description of Artificial Sequence: Synthetic polypeptide
CPASYFQCGNLPHCYPMEWRCDGFPDCIDGSDEKGCGGGGCPSNEFMCPDKVCFPWSFLCDGDNDCQDGSDEEYCGGGG

SEQ ID NO: 563 - protein, 78 aa, Artificial Sequence
  Description of Artificial Sequence: Synthetic polypeptide
CPPDEFQCDNGRCIPEDWLCDGENDCGDGSDEANCGGGGCPSNEFMCPDKVCFPWSFLCDGDNDCQDGSDEEYCGGGG

SEQ ID NO: 564 - protein, 80 aa, Artificial Sequence
  Description of Artificial Sequence: Synthetic polypeptide
CPSGEFQCDSGSCIPEDWVCDGENDCEDGSDEALDNCGGGGCPSNEFMCPDKVCFPWSFLCDGDNDCQDGSDEEYCGGGG

SEQ ID NO: 565 - protein, 13 aa, Artificial Sequence
  Description of Artificial Sequence: Synthetic peptide
SNICEEPYWCWWD

SEQ ID NO: 566 - protein, 13 aa, Artificial Sequence
  Description of Artificial Sequence: Synthetic peptide
AFYCNEDTWCFYE

SEQ ID NO: 567 - protein, 13 aa, Artificial Sequence
  Description of Artificial Sequence: Synthetic peptide
FNICNDGFVCWFE

SEQ ID NO: 568 - protein, 13 aa, Artificial Sequence
  Description of Artificial Sequence: Synthetic peptide
DLRCGFEVLCWTP

SEQ ID NO: 569 - protein, 13 aa, Artificial Sequence
  Description of Artificial Sequence: Synthetic peptide
YYACNHDGWCFYE

SEQ ID NO: 570 - protein, 14 aa, Artificial Sequence
  Description of Artificial Sequence: Synthetic peptide
EVDCIWKGTWCWVV

SEQ ID NO: 571 - protein, 14 aa, Artificial Sequence
  Description of Artificial Sequence: Synthetic peptide
PLSCEWHNGWCWVM

SEQ ID NO: 572 - protein, 14 aa, Artificial Sequence
  Description of Artificial Sequence: Synthetic peptide
WRECPGEWYYCEMW

SEQ ID NO: 573 - protein, 14 aa, Artificial Sequence
  Description of Artificial Sequence: Synthetic peptide
MGKCAWSSGWCFIG

SEQ ID NO: 574 - protein, 14 aa, Artificial Sequence
  Description of Artificial Sequence: Synthetic peptide
YIGCVWNAGWCWVE

SEQ ID NO: 575 - protein, 14 aa, Artificial Sequence
  Description of Artificial Sequence: Synthetic peptide
EFDCYWHEDWCWIE

SEQ ID NO: 576 - protein, 14 aa, Artificial Sequence
  Description of Artificial Sequence: Synthetic peptide
SSWCPFGWADCLQY

SEQ ID NO: 577 - protein, 14 aa, Artificial Sequence
  Description of Artificial Sequence: Synthetic peptide
EIDCNWWMYDCWSF

SEQ ID NO: 578 - protein, 18 aa, Artificial Sequence
  Description of Artificial Sequence: Synthetic peptide
FRLCRDRLLDQYVICSDF

SEQ ID NO: 579 - protein, 18 aa, Artificial Sequence
  Description of Artificial Sequence: Synthetic peptide
PPMCEDKNQYWQSICWLA

SEQ ID NO: 580 - protein, 18 aa, Artificial Sequence
  Description of Artificial Sequence: Synthetic peptide
LPFCEEESYQDWSACWLH

SEQ ID NO: 581 - protein, 18 aa, Artificial Sequence
  Description of Artificial Sequence: Synthetic peptide
LSNCESPFSPWMSICWLP

SEQ ID NO: 582 - protein, 18 aa, Artificial Sequence
  Description of Artificial Sequence: Synthetic peptide
FYICPSSHDDFWDICALS

SEQ ID NO: 583 - protein, 18 aa, Artificial Sequence
  Description of Artificial Sequence: Synthetic peptide
NWFCITPETGELNPCEPS

SEQ ID NO: 584 - protein, 18 aa, Artificial Sequence
  Description of Artificial Sequence: Synthetic peptide
LPRCLDETVSSFPLCWLD

SEQ ID NO: 585 - protein, 17 aa, Artificial Sequence
  Description of Artificial Sequence: Synthetic peptide
DLCGKNWNDNSFHCWWY

SEQ ID NO: 586 - protein, 18 aa, Artificial Sequence
  Description of Artificial Sequence: Synthetic peptide
LYNCVWERKGNWTFCVDD

SEQ ID NO: 587 - protein, 17 aa, Artificial Sequence
  Description of Artificial Sequence: Synthetic peptide
WLECEDLEGRKHTCWFS

SEQ ID NO: 588 - protein, 18 aa, Artificial Sequence
  Description of Artificial Sequence: Synthetic peptide
YFDCVRQHQGWDSMCFYD

SEQ ID NO: 589 - protein, 18 aa, Artificial Sequence
  Description of Artificial Sequence: Synthetic peptide
FRLCVDTEQGYWHICDDW

SEQ ID NO: 590 - protein, 18 aa, Artificial Sequence
  Description of Artificial Sequence: Synthetic peptide
LYQCSDINADDYWACWLD

SEQ ID NO: 591 - protein, 17 aa, Artificial Sequence
  Description of Artificial Sequence: Synthetic peptide
DLWCINREGFLFPCYRD

SEQ ID NO: 592 - protein, 18 aa, Artificial Sequence
  Description of Artificial Sequence: Synthetic peptide
LPFCLNVPEDYTFACWAG

SEQ ID NO: 593 - protein, 16 aa, Artificial Sequence
  Description of Artificial Sequence: Synthetic peptide
LNACLDDPFSTACWLN

SEQ ID NO: 594 - protein, 18 aa, Artificial Sequence
  Description of Artificial Sequence: Synthetic peptide
SSFCHWYDGDTSEPCFFL

SEQ ID NO: 595 - protein, 17 aa, Artificial Sequence
  Description of Artificial Sequence: Synthetic peptide
FWICDVGSSTQHWCLWD

SEQ ID NO: 596 - protein, 18 aa, Artificial Sequence
  Description of Artificial Sequence: Synthetic peptide
HWLCNGWQANWMDICLGH

SEQ ID NO: 597 - protein, 18 aa, Artificial Sequence
  Description of Artificial Sequence: Synthetic peptide
LPLCMIRPNSPQWACWLD

SEQ ID NO: 598 - protein, 18 aa, Artificial Sequence
  Description of Artificial Sequence: Synthetic peptide
WVECNGWFVSEWDMCMLD

SEQ ID NO: 599 - protein, 18 aa, Artificial Sequence
  Description of Artificial Sequence: Synthetic peptide
DLFCMNPDGWFLSPCVDH

SEQ ID NO: 600 - protein, 18 aa, Artificial Sequence
  Description of Artificial Sequence: Synthetic peptide
LPFCSEVDLMDHQMCWLH

SEQ ID NO: 601 - protein, 18 aa, Artificial Sequence
  Description of Artificial Sequence: Synthetic peptide
WHICPSPYAFEWMLCSDY

SEQ ID NO: 602 - protein, 19 aa, Artificial Sequence
  Description of Artificial Sequence: Synthetic peptide
FLYPCDWRSFGSQALCWLD

SEQ ID NO: 603 - protein, 17 aa, Artificial Sequence
  Description of Artificial Sequence: Synthetic peptide
AYYCIDSQDWTLFTCKD

SEQ ID NO: 604 - protein, 18 aa, Artificial Sequence
  Description of Artificial Sequence: Synthetic peptide
LLACSALHNDQGSMCWLD

SEQ ID NO: 605 - protein, 18 aa, Artificial Sequence
  Description of Artificial Sequence: Synthetic peptide
PPRCADLLRASQGICFLD

SEQ ID NO: 606 - protein, 18 aa, Artificial Sequence
  Description of Artificial Sequence: Synthetic peptide
WALCEADNQEDWFICPWN

SEQ ID NO: 607 - protein, 14 aa, Artificial Sequence
  Description of Artificial Sequence: Synthetic peptide
AWECEYNGEWCFLH

SEQ ID NO: 608 - protein, 18 aa, Artificial Sequence
  Description of Artificial Sequence: Synthetic peptide
LRNCEMLDWNDFGLCWFS

SEQ ID NO: 609 - protein, 18 aa, Artificial Sequence
  Description of Artificial Sequence: Synthetic peptide
NGQCWKTSHPQVGNCVGN

SEQ ID NO: 610 - protein, 14 aa, Artificial Sequence
  Description of Artificial Sequence: Synthetic peptide
AWECEYNGEWCFLH

SEQ ID NO: 611 - protein, 13 aa, Artificial Sequence
  Description of Artificial Sequence: Synthetic peptide
WEPCFFEEFCLIE

SEQ ID NO: 612 - protein, 18 aa, Artificial Sequence
  Description of Artificial Sequence: Synthetic peptide
WPLCQAEWEGWYEPCMYW

SEQ ID NO: 613 - protein, 18 aa, Artificial Sequence
  Description of Artificial Sequence: Synthetic peptide
LSWCTDMDPSFWGTCWLA

SEQ ID NO: 614 - protein, 18 aa, Artificial Sequence
  Description of Artificial Sequence: Synthetic peptide
WFNCDMYSGQFRQHCDRH

SEQ ID NO: 615 - protein, 14 aa, Artificial Sequence
  Description of Artificial Sequence: Synthetic peptide
WYPCGEEWYDCWMS

SEQ ID NO: 616 - protein, 18 aa, Artificial Sequence
  Description of Artificial Sequence: Synthetic peptide
LLACGFDGHQRETMCWLD

SEQ ID NO: 617 - protein, 18 aa, Artificial Sequence
  Description of Artificial Sequence: Synthetic peptide
PPHCKEVHPQSGSGCWNP

SEQ ID NO: 618 - protein, 18 aa, Artificial Sequence
  Description of Artificial Sequence: Synthetic peptide
LPACWDDVNYESTACWLD

SEQ ID NO: 619 - protein, 18 aa, Artificial Sequence
  Description of Artificial Sequence: Synthetic peptide
LNWCTWEDEASSTMCWLN

SEQ ID NO: 620 - protein, 18 aa, Artificial Sequence
  Description of Artificial Sequence: Synthetic peptide
NGDCELVKGPVDWECKPA

SEQ ID NO: 621 - protein, 18 aa, Artificial Sequence
  Description of Artificial Sequence: Synthetic peptide
LPDCKDATWNSFSACWLD

SEQ ID NO: 622 - protein, 18 aa, Artificial Sequence
  Description of Artificial Sequence: Synthetic peptide
YAECMDSLEQLDYNCFLP

SEQ ID NO: 623 - protein, 18 aa, Artificial Sequence
  Description of Artificial Sequence: Synthetic peptide
LFSCDDTSAMQSTMCWLP

SEQ ID NO: 624 - protein, 13 aa, Artificial Sequence
  Description of Artificial Sequence: Synthetic peptide
DWVCGVDIECEMW

SEQ ID NO: 625 - protein, 18 aa, Artificial Sequence
  Description of Artificial Sequence: Synthetic peptide
LNLCWENQPDDDSACWLD

SEQ ID NO: 626 - protein, 14 aa, Artificial Sequence
  Description of Artificial Sequence: Synthetic peptide
EQDCGQEWLYCEFI

SEQ ID NO: 627 - protein, 13 aa, Artificial Sequence
  Description of Artificial Sequence: Synthetic peptide
WSICEEGYKCWWE

SEQ ID NO: 628 - protein, 18 aa, Artificial Sequence
  Description of Artificial Sequence: Synthetic peptide
PPRCADLLRASQGICFLD

SEQ ID NO: 629 - protein, 14 aa, Artificial Sequence
  Description of Artificial Sequence: Synthetic peptide
SDICYWSEGWCWIE

SEQ ID NO: 630 - protein, 14 aa, Artificial Sequence
  Description of Artificial Sequence: Synthetic peptide
DTNCMWRDGWCFLQ

SEQ ID NO: 631 - protein, 18 aa, Artificial Sequence
  Description of Artificial Sequence: Synthetic peptide
DAACWLQMRGSTWECVYH

SEQ ID NO: 632 - protein, 18 aa, Artificial Sequence
  Description of Artificial Sequence: Synthetic peptide
LPMCTYMGSTWTEMCWLD

SEQ ID NO: 633 - protein, 13 aa, Artificial Sequence
  Description of Artificial Sequence: Synthetic peptide
KPMCHPQNHCEEE

SEQ ID NO: 634 - protein, 13 aa, Artificial Sequence
  Description of Artificial Sequence: Synthetic peptide
YWNCETDSFCLWQ

SEQ ID NO: 635 - protein, 13 aa, Artificial Sequence
  Description of Artificial Sequence: Synthetic peptide
DLVCGVDVMCWYL

SEQ ID NO: 636 - protein, 13 aa, Artificial Sequence
  Description of Artificial Sequence: Synthetic peptide
NVVCNGDNWCFYV

SEQ ID NO: 637 - protein, 13 aa, Artificial Sequence
  Description of Artificial Sequence: Synthetic peptide
DLRCGFEVLCWTP

SEQ ID NO: 638 - protein, 18 aa, Artificial Sequence
  Description of Artificial Sequence: Synthetic peptide
NWNCLDAHPQVGTNCEYN

SEQ ID NO: 639 - protein, 18 aa, Artificial Sequence
  Description of Artificial Sequence: Synthetic peptide
NGQCWKTSHPQVGNCVGN

SEQ ID NO: 640 - protein, 13 aa, Artificial Sequence
  Description of Artificial Sequence: Synthetic peptide
DIECSEVDWCWED

SEQ ID NO: 641 - protein, 18 aa, Artificial Sequence
  Description of Artificial Sequence: Synthetic peptide
LHACKNHKYGYQSLCWLD

SEQ ID NO: 642 - protein, 18 aa, Artificial Sequence
  Description of Artificial Sequence: Synthetic peptide
PPLCEDSSTSFETVCFLD

SEQ ID NO: 643 - protein, 18 aa, Artificial Sequence
  Description of Artificial Sequence: Synthetic peptide
YRVCTDKSNQNWVLCSFD

SEQ ID NO: 644 - protein, 18 aa, Artificial Sequence
  Description of Artificial Sequence: Synthetic peptide
LPDCETQAGKHAMLCWLN

SEQ ID NO: 645 - protein, 18 aa, Artificial Sequence
  Description of Artificial Sequence: Synthetic peptide
DWYCLSNDHSTLVQCEDY

SEQ ID NO: 646 - protein, 18 aa, Artificial Sequence
  Description of Artificial Sequence: Synthetic peptide
WFLCDTQDHKHWQLCANP

SEQ ID NO: 647 - protein, 18 aa, Artificial Sequence
  Description of Artificial Sequence: Synthetic peptide
PPLCKDVRGQYFGMCFLS

SEQ ID NO: 648 - protein, 18 aa, Artificial Sequence
  Description of Artificial Sequence: Synthetic peptide
LPHCDAQENPYATLCWWD

SEQ ID NO: 649 - protein, 13 aa, Artificial Sequence
  Description of Artificial Sequence: Synthetic peptide
GVYCNKQGWCFYS

SEQ ID NO: 650 - protein, 14 aa, Artificial Sequence
  Description of Artificial Sequence: Synthetic peptide
YKECHPQGEHCFEF

SEQ ID NO: 651 - protein, 14 aa, Artificial Sequence
  Description of Artificial Sequence: Synthetic peptide
WRECPGEWYYCEMW

SEQ ID NO: 652 - protein, 18 aa, Artificial Sequence
  Description of Artificial Sequence: Synthetic peptide
LRFCRDGGVDTTWICWYD

SEQ ID NO: 653 - protein, 13 aa, Artificial Sequence
  Description of Artificial Sequence: Synthetic peptide
ELICWNDNWCYIE

SEQ ID NO: 654 - protein, 18 aa, Artificial Sequence
  Description of Artificial Sequence: Synthetic peptide
DDGCWLMKNGNFWQCSNS

SEQ ID NO: 655 - protein, 14 aa, Artificial Sequence
  Description of Artificial Sequence: Synthetic peptide
IYRCKSSFDQCLMY

SEQ ID NO: 656 - protein, 13 aa, Artificial Sequence
  Description of Artificial Sequence: Synthetic peptide
LYYCGDDLYCFDI

SEQ ID NO: 657 - protein, 13 aa, Artificial Sequence
  Description of Artificial Sequence: Synthetic peptide
FNICNDGFVCWFE

SEQ ID NO: 658 - protein, 14 aa, Artificial Sequence
  Description of Artificial Sequence: Synthetic peptide
EFDCYWHEDWCWIE

SEQ ID NO: 659 - protein, 18 aa, Artificial Sequence
  Description of Artificial Sequence: Synthetic peptide
DWWCIDHTSGKLMPCQNS

SEQ ID NO: 660 - protein, 20 aa, Artificial Sequence
  Description of Artificial Sequence: Synthetic peptide
RVLRCCQLLDYESTACWLDC

SEQ ID NO: 661 - protein, 24 aa, Artificial Sequence
  Description of Artificial Sequence: Synthetic peptide
SADRQLCLSVRSGWYEPCMYWGAL

SEQ ID NO: 662 - protein, 24 aa, Artificial Sequence
  Description of Artificial Sequence: Synthetic peptide
TLDLPACWDDVNYESTACWLDGGG

SEQ ID NO: 663 - protein, 24 aa, Artificial Sequence
  Description of Artificial Sequence: Synthetic peptide
VEDRQLCLSQTDGWYEPCMYWGDQ

SEQ ID NO: 664 - protein, 24 aa, Artificial Sequence
  Description of Artificial Sequence: Synthetic peptide
PLDLPACWDDVNYESTACWLDGGG

SEQ ID NO: 665 - protein, 20 aa, Artificial Sequence
  Description of Artificial Sequence: Synthetic peptide
DLRWCSQQLEYESTACWLDE

SEQ ID NO: 666 - protein, 24 aa, Artificial Sequence
  Description of Artificial Sequence: Synthetic peptide
GGGWPLCQAEWEGWYEPCMYWGWQ

SEQ ID NO: 667 - protein, 24 aa, Artificial Sequence
  Description of Artificial Sequence: Synthetic peptide
QDYRSLCWMSRSGWYEPCMYWGGG

SEQ ID NO: 668 - protein, 20 aa, Artificial Sequence
  Description of Artificial Sequence: Synthetic peptide
REVLCCHDLDYESTACWLDC

SEQ ID NO: 669 - protein, 24 aa, Artificial Sequence
  Description of Artificial Sequence: Synthetic peptide
HELVGRCSQEPSYQCRRCSVAYGQ

SEQ ID NO: 670 - protein, 22 aa, Artificial Sequence
  Description of Artificial Sequence: Synthetic peptide
QFDLPACWDDVESTACWLDGGG

SEQ ID NO: 671 - protein, 20 aa, Artificial Sequence
  Description of Artificial Sequence: Synthetic peptide
EIGLCSEDLNYESTACWLDE

SEQ ID NO: 672 - protein, 24 aa, Artificial Sequence
  Description of Artificial Sequence: Synthetic peptide
NSDRGLCPIDSSGWYEPCMYWGEQ

SEQ ID NO: 673 - protein, 24 aa, Artificial Sequence
  Description of Artificial Sequence: Synthetic peptide
NQAWVLCEAEEDGWYEPCMYWGRG

SEQ ID NO: 674 - protein, 24 aa, Artificial Sequence
  Description of Artificial Sequence: Synthetic peptide
SLDRQLCFVVSEGWYEPCMYWGKD

SEQ ID NO: 675 - protein, 24 aa, Artificial Sequence
  Description of Artificial Sequence: Synthetic peptide
DAFYAECMDSLEEVDYNCFLPETV

SEQ ID NO: 676 - protein, 24 aa, Artificial Sequence
  Description of Artificial Sequence: Synthetic peptide
TSTYRECIDWDDQLDYNCFLPDSQ

SEQ ID NO: 677 - protein, 24 aa, Artificial Sequence
  Description of Artificial Sequence: Synthetic peptide
FLVYAECMDSLEELDYNCFLPYEE

SEQ ID NO: 678 - protein, 24 aa, Artificial Sequence
  Description of Artificial Sequence: Synthetic peptide
DVFYAECMDSLEEVDYNCFLPEND

SEQ ID NO: 679 - protein, 24 aa, Artificial Sequence
  Description of Artificial Sequence: Synthetic peptide
SLPQRQYFQCVHQLDYNCFLPERG

SEQ ID NO: 680 - protein, 24 aa, Artificial Sequence
  Description of Artificial Sequence: Synthetic peptide
FLVYRQCMDFGDQLDYNCFLPDDA

SEQ ID NO: 681 - protein, 24 aa, Artificial Sequence
  Description of Artificial Sequence: Synthetic peptide
DRAYRQCIDWVDQLDYNCFLPDQS

SEQ ID NO: 682 - protein, 24 aa, Artificial Sequence
  Description of Artificial Sequence: Synthetic peptide
DLQFRNCNDWVDQLDYNCFLPEPD

SEQ ID NO: 683 - protein, 24 aa, Artificial Sequence
  Description of Artificial Sequence: Synthetic peptide
DVAYAECMDSLEDVDYNCFLPEDQ

SEQ ID NO: 684 - protein, 24 aa, Artificial Sequence
  Description of Artificial Sequence: Synthetic peptide
FSHDRQYMLCVHQLDYNCFLPEPQ

SEQ ID NO: 685 - protein, 24 aa, Artificial Sequence
  Description of Artificial Sequence: Synthetic peptide
DAFYAECMDSLEYVDYNCFLPDLA

SEQ ID NO: 686 - protein, 24 aa, Artificial Sequence
  Description of Artificial Sequence: Synthetic peptide
RQDRALCWHSGEGWYEPCMYWGAA

SEQ ID NO: 687 - protein, 24 aa, Artificial Sequence
  Description of Artificial Sequence: Synthetic peptide
DQVWRDCIDWVHQLDYNCFLPDDE

SEQ ID NO: 688 - protein, 24 aa, Artificial Sequence
  Description of Artificial Sequence: Synthetic peptide
DVFYAECMDSLEQIDYNCFLPELQ

SEQ ID NO: 689 - protein, 24 aa, Artificial Sequence
  Description of Artificial Sequence: Synthetic peptide
DTPYRLCRDWVEQLDYNCFLPESD

SEQ ID NO: 690 - protein, 24 aa, Artificial Sequence
  Description of Artificial Sequence: Synthetic peptide
SVLYAECMDWEQQLDYNCFLPDED

SEQ ID NO: 691 - protein, 24 aa, Artificial Sequence
  Description of Artificial Sequence: Synthetic peptide
VIFYAECMDSLEELDYNCFLPEPE

SEQ ID NO: 692 - protein, 24 aa, Artificial Sequence
  Description of Artificial Sequence: Synthetic peptide
YSQYAECMDSLEELDYNCFLPETE

SEQ ID NO: 693 - protein, 24 aa, Artificial Sequence
  Description of Artificial Sequence: Synthetic peptide
WVAYRQCIDSVHQLDYNCFLPDWD

SEQ ID NO: 694 - protein, 24 aa, Artificial Sequence
  Description of Artificial Sequence: Synthetic peptide
FVFYAECMDSLEELDYNCFLPMTE

SEQ ID NO: 695 - protein, 24 aa, Artificial Sequence
  Description of Artificial Sequence: Synthetic peptide
SIPYRECMDWVDQLDYNCFLPDQD

SEQ ID NO: 696 - protein, 24 aa, Artificial Sequence
  Description of Artificial Sequence: Synthetic peptide
TRAYRECIHFVHQLDYNCFLPDED

SEQ ID NO: 697 - protein, 24 aa, Artificial Sequence
  Description of Artificial Sequence: Synthetic peptide
TVYYRQCMDWVDQLDYNCFLPEDH

SEQ ID NO: 698 - protein, 24 aa, Artificial Sequence
  Description of Artificial Sequence: Synthetic peptide
YQANRQYMQCAHQLDYNCFLPDWW

SEQ ID NO: 699 - protein, 24 aa, Artificial Sequence
  Description of Artificial Sequence: Synthetic peptide
DALYLNCIQWVDQLDYNCFLPDDE

SEQ ID NO: 700 - protein, 24 aa, Artificial Sequence
  Description of Artificial Sequence: Synthetic peptide
LRQYRQCIDWGQQLDYNCFLPMEE

SEQ ID NO: 701 - protein, 24 aa, Artificial Sequence
  Description of Artificial Sequence: Synthetic peptide
TVAYAECMDSLEELDYNCFLPQEL

SEQ ID NO: 702 - protein, 24 aa, Artificial Sequence
  Description of Artificial Sequence: Synthetic peptide
VVRYRPCMDWGQQLDYNCFLPDGQ

SEQ ID NO: 703 - protein, 24 aa, Artificial Sequence
  Description of Artificial Sequence: Synthetic peptide
SYMYRHYFQCVQQLDYNCFLPEQT

SEQ ID NO: 704 - protein, 24 aa, Artificial Sequence
  Description of Artificial Sequence: Synthetic peptide
WWQLRDCKHWEHQLDYNCFLPWAE

SEQ ID NO: 705 - protein, 24 aa, Artificial Sequence
  Description of Artificial Sequence: Synthetic peptide
VVYYAECMDSLEEVDYNCFLPYEQ

SEQ ID NO: 706 - protein, 24 aa, Artificial Sequence
  Description of Artificial Sequence: Synthetic peptide
YGDRNLCYDQDSGWYEPCMYWTEG

SEQ ID NO: 707 - protein, 24 aa, Artificial Sequence
  Description of Artificial Sequence: Synthetic peptide
GGTRELCWLAAQGWYEPCMYWAEG

SEQ ID NO: 708 - protein, 24 aa, Artificial Sequence
  Description of Artificial Sequence: Synthetic peptide
GGGWPLCQAEWEGWYEPCMYWGYY

SEQ ID NO: 709 - protein, 24 aa, Artificial Sequence
  Description of Artificial Sequence: Synthetic peptide
GGTRQLCLSEPFGWYEPCMYWGAS

SEQ ID NO: 710 - protein, 24 aa, Artificial Sequence
  Description of Artificial Sequence: Synthetic peptide
GGGWPLCQAEWEGWYEPCMYWGAG

SEQ ID NO: 711 - protein, 24 aa, Artificial Sequence
  Description of Artificial Sequence: Synthetic peptide
GGGWPLCQAEWEGWYEPCMYWGVG

SEQ ID NO: 712 - protein, 24 aa, Artificial Sequence
  Description of Artificial Sequence: Synthetic peptide
FADREVCYLPERGWYEPCMYWGSQ

SEQ ID NO: 713 - protein, 24 aa, Artificial Sequence
  Description of Artificial Sequence: Synthetic peptide
DGDRAICFNSHQGWYEPCMYWAGR

SEQ ID NO: 714 - protein, 469 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGTSTYRECIDWDDQLDYNCFLPDSQ

SEQ ID NO: 715 - protein, 469 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGDVAYAECMDSLEDVDYNCFLPEDQ

SEQ ID NO: 716 - protein, 469 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGDAFYAECMDSLEYVDYNCFLPDLA

SEQ ID NO: 717 - protein, 469 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVARPSVFLFPQKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSVLYAECMDWEQQLDYNCFLPDED

SEQ ID NO: 718 - protein, 469 aa, Artificial Sequence
  Description of Artificial Sequence: Synthetic polypeptide
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGYSQYAECMDSLEELDYNCFLPETE

SEQ ID NO: 719 - protein, 35 aa, Artificial Sequence
  Description of Artificial Sequence: Synthetic polypeptide
  MOD_RES (2)..(7): Any amino acid
  MOD_RES (9)..(12): Any amino acid
  MOD_RES (14)..(19): Any amino acid
  MOD_RES (21)..(25): Any amino acid
  MOD_RES (27)..(34): Any amino acid
CXXXXXXCXXXXCXXXXXXCXXXXXCXXXXXXXXC

SEQ ID NO: 720 - protein, 212 aa, Homo sapiens
MQLPLALCLVCLLVHTAPRVVEGQGWQAPKNDATEIIPELGEYPEPPPELENNKTMNRAEMGGRPPHHPFETKDVSEYSCRELHPTRYVTDGPCRSAKPVTELVCSGQCGPARLLPNAIGRGKWWRPSGPDFRCIPDRYRAQRVQLLCPGGEAPRARKVRLVASCKCRLTRFHNQSELKDFGTEAARPQKGRKPRPRARSAKANQAELENAY

SEQ ID NO: 721 - protein, 26 aa, Homo sapiens
CGPARLLPNAIGRGKWWRPSGPDFRC

SEQ ID NO: 722 - protein, 14 aa, Homo sapiens
DVSEYSCRELHFTR

SEQ ID NO: 723 - protein, 18 aa, Homo sapiens
SAKPVTELVCSGQCGPAR

SEQ ID NO: 724 - protein, 17 aa, Homo sapiens
WWRPSGPDFRCIPDRYR

SEQ ID NO: 725 - protein, 12 aa, Homo sapiens
LVASCKCKRLTR

SEQ ID NO: 726 - protein, 14 aa, Homo sapiens
SAKPVTELVCSGQC

SEQ ID NO: 727 - protein, 7 aa, Homo sapiens
LVASCKC

SEQ ID NO: 728 - protein, 8 aa, Homo sapiens
CRELHFTR

SEQ ID NO: 729 - protein, 7 aa, Homo sapiens
CIPDRYR

SEQ ID NO: 730 - protein, 6 aa, Artificial Sequence
  Description of Artificial Sequence: Synthetic 6xHis tag
HHHHHH

SEQ ID NO: 731 - protein, 45 aa, Artificial Sequence
  Description of Artificial Sequence: Synthetic polypeptide
CGSSEFPCQGTDICLSPAWRCDGDDDCLDNSDEANCSQDPEFHKV

SEQ ID NO: 732 - protein, 41 aa, Artificial Sequence
  Description of Artificial Sequence: Synthetic polypeptide
CTAEAFMCRNATPCVSRGKVCDGVPDCPDGSDEIPHCPYRT

SEQ ID NO: 733 - protein, 87 aa, Artificial Sequence
  Description of Artificial Sequence: Synthetic polypeptide
CVPGEFTCKNGHCVSLDWLCDGDDDCGDGSDEPPDCETSERTCGSREFPCQGTDICLPPAWLCDGDDDCLDNPDEAYCSQDPEFHKV

SEQ ID NO: 734 - DNA, 27 bp, Artificial Sequence
  Description of Artificial Sequence: Synthetic oligonucleotide
tccatggccgctgagggcaccggtgac

SEQ ID NO: 735 - DNA, 31 bp, Artificial Sequence
  Description of Artificial Sequence: Synthetic oligonucleotide
cctgatcctggccctaccgacaactctgcag

SEQ ID NO: 736 - DNA, 24 bp, Artificial Sequence
  Description of Artificial Sequence: Synthetic oligonucleotide
ttctattctcacagtgcacagggt

SEQ ID NO: 737 - DNA, 24 bp, Artificial Sequence
  Description of Artificial Sequence: Synthetic oligonucleotide
cattctctcgagactgttgaaagt

SEQ ID NO: 738 - DNA, 24 bp, Artificial Sequence
  Description of Artificial Sequence: Synthetic oligonucleotide
actttcaacagtctcgagagaatg

SEQ ID NO: 739 - protein, 24 aa, Artificial Sequence
  Description of Artificial Sequence: Synthetic peptide
LLSRMICQIDQTGWYEPCMYWQGS

SEQ ID NO: 740 - protein, 4 aa, Artificial Sequence
  Description of Artificial Sequence: Synthetic peptide
AYHT

SEQ ID NO: 741 - protein, 4 aa, Artificial Sequence
  Description of Artificial Sequence: Synthetic peptide
GGGG

SEQ ID NO: 742 - protein, 10 aa, Artificial Sequence
  Description of Artificial Sequence: Synthetic peptide
SAPAEPPGSL

SEQ ID NO: 743 - protein, 5 aa, Artificial Sequence
  Description of Artificial Sequence: Synthetic peptide
GGGGS

SEQ ID NO: 744 - protein, 11 aa, Artificial Sequence
  Description of Artificial Sequence: Synthetic peptide
SAPASEPPGSL

The invention claimed is:

1. A polypeptide comprising a non-naturally-occurring monomer domain capable of binding sclerostin, wherein the monomer domain comprises the amino acid sequence of DVAYAECMDSLEDVDYNCFLPEDQ (SEQ ID NO: 683).

2. The polypeptide according to claim 1, with an affinity ($K_D$) to sclerostin of less than or equal to $1 \times 10^{-7}$ M.

3. The polypeptide according to claim 1 comprising a dimer of the monomer domain.

4. The polypeptide of claim 1, further comprising a polypeptide having affinity to DKK1 selected from Tables 16-19.

5. The polypeptide of any one of claims 1, 2, 3, and 4, further comprising a polyethylene glycol (PEG) conjugation or fusion.

6. A peptide fusion comprising a polypeptide comprising a non-naturally-occurring monomer domain capable of binding sclerostin fused to an antibody or fragment thereof, wherein the monomer domain comprises the amino acid sequence DVAYAECMDSLEDVDYNCFLPEDQ (SEQ ID NO: 683).

7. The peptide fusion claim 6, wherein the polypeptide is fused to the heavy chain or the light chain of the antibody.

8. The peptide fusion of claim 6, wherein the polypeptide comprises a dimer of the monomer domain.

9. The peptide fusion of claim 7, 6 or 8, wherein the polypeptide is fused to a human Fc.

10. The peptide fusion of claim 7, 6 or 8, wherein the antibody is an anti-DKK antibody.

* * * * *